United States Patent
Karow et al.

(10) Patent No.: US 11,053,294 B2
(45) Date of Patent: Jul. 6, 2021

(54) MASKED CYTOKINE POLYPEPTIDES

(71) Applicant: Xilio Development, Inc., Waltham, MA (US)

(72) Inventors: Margaret Karow, Santa Rosa Valley, CA (US); Deborah Moore Lai, Beverly, MA (US); Dheeraj Singh Tomar, Dorchester, MA (US); Parker Johnson, Allston, MA (US); Raphael Rozenfeld, Newton, MA (US); Ronan O'Hagan, Waltham, MA (US); Huawei Qiu, Westborough, MA (US)

(73) Assignee: Xilio Development, Inc., Waltham, MA (US)

( * ) Notice: Subject to any disclaimer, the term of this patent is extended or adjusted under 35 U.S.C. 154(b) by 0 days.

(21) Appl. No.: 17/002,742

(22) Filed: Aug. 25, 2020

(65) Prior Publication Data
US 2021/0002343 A1  Jan. 7, 2021

Related U.S. Application Data

(63) Continuation of application No. PCT/US2019/053588, filed on Sep. 27, 2019.

(60) Provisional application No. 62/891,199, filed on Aug. 23, 2019, provisional application No. 62/888,276, filed on Aug. 16, 2019, provisional application No. 62/737,803, filed on Sep. 27, 2018.

(51) Int. Cl.
*C07K 14/55* (2006.01)
*A61K 38/00* (2006.01)
*A61P 35/00* (2006.01)

(52) U.S. Cl.
CPC .............. *C07K 14/55* (2013.01); *A61P 35/00* (2018.01); *A61K 38/00* (2013.01); *C07K 2317/52* (2013.01); *C07K 2317/94* (2013.01); *C07K 2319/30* (2013.01)

(58) Field of Classification Search
CPC ............................ C07K 14/55; A61K 38/2013
See application file for complete search history.

(56) References Cited

U.S. PATENT DOCUMENTS

| | | |
|---|---|---|
| 4,419,446 A | 12/1983 | Howley et al. |
| 4,560,655 A | 12/1985 | Baker |
| 4,601,978 A | 7/1986 | Karin |
| 4,657,866 A | 4/1987 | Kumar |
| 4,676,980 A | 6/1987 | Segal et al. |
| 4,767,704 A | 8/1988 | Cleveland |
| 4,816,567 A | 3/1989 | Cabilly et al. |
| 4,927,762 A | 5/1990 | Darfler |
| 4,965,199 A | 10/1990 | Capon et al. |
| 5,122,464 A | 6/1992 | Wilson et al. |
| 5,122,469 A | 6/1992 | Mather et al. |
| 5,208,020 A | 5/1993 | Chari et al. |
| 5,264,365 A | 11/1993 | Georgiou |
| 5,416,064 A | 5/1995 | Chari et al. |
| 5,508,192 A | 4/1996 | Georgiou et al. |
| 5,571,894 A | 11/1996 | Wels et al. |
| 5,587,458 A | 12/1996 | King et al. |
| 5,624,821 A | 4/1997 | Winter et al. |
| 5,635,483 A | 6/1997 | Pettit et al. |
| 5,639,635 A | 6/1997 | Joly et al. |
| 5,641,870 A | 6/1997 | Rinderknecht et al. |
| 5,648,237 A | 7/1997 | Carter et al. |
| 5,648,260 A | 7/1997 | Winter et al. |
| 5,712,374 A | 1/1998 | Kunstmann et al. |
| 5,714,586 A | 2/1998 | Kunstmann et al. |
| 5,739,277 A | 4/1998 | Presta et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |

(Continued)

FOREIGN PATENT DOCUMENTS

| | | |
|---|---|---|
| EP | 2 639 241 A2 | 9/2013 |
| EP | 3 792 277 A1 | 3/2021 |

(Continued)

OTHER PUBLICATIONS

Bernett et al., "Potency-reduced IL15/IL15Rα heterodimeric Fc-fusions display enhanced in vivo activity through increased exposure," Xencor, AACR (2018) Abstract #5565.

(Continued)

*Primary Examiner* — Prema M Mertz
(74) *Attorney, Agent, or Firm* — Morrison and Foerster LLP

(57) ABSTRACT

Provided herein are cytokines or functional fragments thereof that, in some embodiments, are engineered to be masked by a masking moiety at one or more receptor binding site(s) of the cytokine or functional fragment thereof. In some embodiments, the cytokines are engineered to be activatable by a protease at a target site, such as in a tumor microenvironment, by including a proteolytically cleavable linker. In some embodiments, the proteolytically cleavable linker links the cytokine to the masking moiety, links the cytokine to a half-life extension domain, and/or links the masking moiety to a half-life extension domain. The masking moiety blocks, occludes, inhibits (e.g., decreases) or otherwise prevents (e g masks) the activity or binding of the cytokine to its cognate receptor or protein. Upon proteolytic cleavage of the cleavable linker at the target site, the cytokine becomes activated, which renders it capable of binding to its cognate receptor or protein with increased affinity.

15 Claims, 52 Drawing Sheets
Specification includes a Sequence Listing.

(56) References Cited

U.S. PATENT DOCUMENTS

| | | | |
|---|---|---|---|
| 5,834,597 A | 11/1998 | Tso et al. |
| 5,869,046 A | 2/1999 | Presta et al. |
| 5,877,296 A | 3/1999 | Hamann et al. |
| 5,891,693 A | 4/1999 | Bebbington et al. |
| 5,939,598 A | 8/1999 | Kucherlapati et al. |
| 6,027,888 A | 2/2000 | Georgiou et al. |
| 6,075,181 A | 6/2000 | Kucherlapati et al. |
| 6,083,715 A | 7/2000 | Georgiou et al. |
| 6,114,598 A | 9/2000 | Kucherlapati et al. |
| 6,150,584 A | 11/2000 | Kucherlapati et al. |
| 6,162,963 A | 12/2000 | Kucherlapati et al. |
| 6,165,745 A | 12/2000 | Ward et al. |
| 6,248,516 B1 | 6/2001 | Winter et al. |
| 6,602,684 B1 | 8/2003 | Umana et al. |
| 6,630,579 B2 | 10/2003 | Chari et al. |
| 6,821,505 B2 | 11/2004 | Ward et al. |
| 6,942,853 B2 | 9/2005 | Chernajovsky et al. |
| 7,498,298 B2 | 3/2009 | Doronina et al. |
| 8,399,219 B2 | 3/2013 | Stagliano et al. |
| 9,206,243 B2 | 12/2015 | Leon Monzon et al. |
| 2002/0164328 A1 | 11/2002 | Shinkawa et al. |
| 2003/0157108 A1 | 8/2003 | Presta et al. |
| 2003/0190311 A1 | 10/2003 | Dall'Acqua et al. |
| 2004/0093621 A1 | 5/2004 | Shitara et al. |
| 2004/0109865 A1 | 6/2004 | Niwa et al. |
| 2004/0110282 A1 | 6/2004 | Kanda et al. |
| 2004/0132140 A1 | 7/2004 | Satoh et al. |
| 2005/0014934 A1 | 1/2005 | Hinton et al. |
| 2006/0236411 A1 | 10/2006 | Dreher et al. |
| 2007/0048282 A1 | 3/2007 | Rosen et al. |
| 2007/0269422 A1 | 11/2007 | Beirnaert et al. |
| 2013/0089516 A1 | 4/2013 | Frelinger et al. |
| 2016/0152686 A1 | 6/2016 | Camphausen et al. |
| 2017/0240608 A1 | 8/2017 | Stagliano et al. |

FOREIGN PATENT DOCUMENTS

| | | |
|---|---|---|
| WO | WO-87/00195 | 1/1987 |
| WO | WO-90/03430 | 4/1990 |
| WO | WO-1991/01743 | 2/1991 |
| WO | WO-93/08829 | 5/1993 |
| WO | WO-93/16185 | 8/1993 |
| WO | WO-94/11026 | 5/1994 |
| WO | WO-94/29351 | 12/1994 |
| WO | WO-1996/027011 | 9/1996 |
| WO | WO-1997/30087 | 8/1997 |
| WO | WO-1998/58964 | 12/1998 |
| WO | WO-1999/22764 | 5/1999 |
| WO | WO-99/51642 | 10/1999 |
| WO | WO-2000/61739 | 10/2000 |
| WO | WO-2001/079271 A1 | 10/2001 |
| WO | WO-2002/43478 | 6/2002 |
| WO | WO-2002/076489 | 10/2002 |
| WO | WO-2003/011878 | 2/2003 |
| WO | WO-2003/59934 A2 | 7/2003 |
| WO | WO-2003/084570 | 10/2003 |
| WO | WO-2003/085119 | 10/2003 |
| WO | WO-2004/041865 | 5/2004 |
| WO | WO-2004/056312 | 7/2004 |
| WO | WO-2005/035586 | 4/2005 |
| WO | WO-2005/035778 | 4/2005 |
| WO | WO-2005/053742 | 6/2005 |
| WO | WO-2006/106905 A1 | 10/2006 |
| WO | WO-2011/124718 | 10/2011 |
| WO | WO-2012/059486 | 5/2012 |
| WO | WO-2016/200645 A1 | 12/2016 |
| WO | WO-2018/071918 | 4/2018 |
| WO | WO-2019/173832 A2 | 9/2019 |
| WO | WO-2019/214757 A1 | 11/2019 |
| WO | WO-2019/222294 A1 | 11/2019 |
| WO | WO-2019/222295 A1 | 11/2019 |
| WO | WO-2019/246392 | 12/2019 |
| WO | WO-2020/069398 A1 | 4/2020 |
| WO | WO-2020/252264 A1 | 12/2020 |
| WO | WO-2021/016599 A1 | 1/2021 |
| WO | WO-2021/030483 A1 | 2/2021 |

OTHER PUBLICATIONS

Caescu et al., "Active site determinants of substrate recognition by the metalloproteinases TACE and ADAM10," Biochem. J. (2010) 424(1):79-88.
Puskas et al., "Development of an attenuated interleukin-2 fusion protein that can be activated by tumour-expressed proteases," Immunology (2011) 133:206-220.
U.S. Appl. No. 17/279,407, filed (Int'l) Sep. 27, 2019, by Karow et al. (a copy is not submitted herewith pursuant to the waiver of 37 C.F.R. § 1.98(a)(2)(iii) issued by the Office on Sep. 21, 2004).
Arie et al. "Chaperone function of FkpA, a heat shock prolyl isomerase, in the periplasm of Escherichia coli," (2001) Mol. Microbiol. 39:199-210.
Atwell et al., "Stable heterodimers from remodeling the domain interface of a homodimer using a phage display library," J. Mol. Biol. (1997) 270(1):26-35.
Bachmann, Cellular and Molecular Biology, vol. 2 (Washington, D.C.: American Society for Microbiology, 1987), pp. 1190-1219.
Barnes et al., "Methods for growth of cultured cells in serum-free medium," Anal. Biochem. 102:255 (1980).
Bass et al., "Hormone phage: an enrichment method for variant proteins with altered binding properties," Proteins, 8:309-314 (1990).
Boerner et al., "Production of antigen-specific human monoclonal antibodies from in vitro-primed human splenocytes," J. Immunol., 147: 86 (1991).
Bothmann and Pluckthun. "Improving Expression of scFv Fragments by Coexpression of Periplasmic Chaperones," (2000) J. Biol. Chem. 275:17100-17105.
Brennan et al., "Preparation of bispecific antibodies by chemical recombination of monoclonal immunoglobulin G1 fragments," Science, 229:81 (1985).
Brodeur et al., Monoclonal Antibody Production Techniques and Applications, pp. 51-63 Marcel Dekker, Inc., New York, 1987.
Carter et al., "High level Escherichia coli expression and production of a bivalent humanized antibody fragment," Bio/Technology 10: 163-167 (1992).
Carter et al. (2001), "Bispecific human IgG by design," J. Immunol. Methods, 248: 7-15.
Chapman et al. (1999) "Therapeutic antibody fragments with prolonged in vivo half-lives," Nature Biotechnol., 17:780-783.
Chari et al., "Immunoconjugates containing novel maytansinoids: promising anticancer drugs," Cancer Res. 52:127-131 (1992).
Chen et al. (1999) "Chaperone activity of DsbC," J. Biol. Chem. 274:19601-19605.
Choe et al. (2016) "Fc-Binding Ligands of Immunoglobulin G: An Overview of High Affinity Proteins and Peptides," Materials 9(12): 994.
Cunningham and Wells (1989) "High-resolution epitope mapping of hGH-receptor interactions by alanine-scanning mutagenesis," Science, 244:1081-1085.
Davies et al., "Antibody-antigen complexes," Annual Rev Biochem. 59:439-473, (1990).
Dennis et al. (2002), "Albumin binding as a general strategy for improving the pharmacokinetics of proteins," JBC 277(38): 35035-35043.
Dubowchik et al., "Doxorubicin Immunoconjugates Containing Bivalent, Lysosomally-Cleavable Dipeptide Linkages," Bioorg. & Med. Chem. Letters 12:1529-1532 (2002).
Duncan and Winter, "The binding site for C1q on IgG," Nature 322:738-40 (1988).
Damodaran (2010) "Protein PEGylation: An overview of chemistry and process considerations," European Pharmaceutical Review, 15(1): 18-26.
Firan, M., et al., "The MHC class I-related receptor, FcRn, plays an essential role in the maternofetal transfer of γ-globulin in humans," Int. Immunol. 13 (2001) 993-1002.

(56) References Cited

OTHER PUBLICATIONS

Fishwild, D. et al. (1996) "High-avidity human IgG kappa monoclonal antibodies from a novel strain of minilocus transgenic mice," Nature Biotechnology 14: 845-851.

Graham et al., "Characteristics of a human cell line transformed by DNA from human adenovirus type 5," J. Gen Virol. 36:59 (1977).

Gunasekaran et al., "Enhancing antibody Fc heterodimer formation through electrostatic steering effects: applications to bispecific molecules and monovalent IgG," J Biol Chem. (2010) 285(25): 19637-19646.

Guss et al., "Structure of the IgG-binding regions of streptococcal protein G.," EMBO J. 5:15671575 (1986).

Guyer et al., "Immunoglobulin Binding by Mouse Intestinal Epithelial Cell Receptors," J. Immunol. 117:587 (1976).

Ham et al., "Media and Growth Requirements," Meth. Enz. 58:44 (1979).

Hara et al., "Overproduction of Penicillin-Binding Protein 7 Suppresses Thermosensitive Grovvth Defect at Low Osmolarity due to an spr Mutation of *Escherichia coli*," Microbial Drug Resistance, 2:63-72 (1996).

Hinman et al., "Preparation and characterization of monoclonal antibody conjugates of the calicheamicins: a novel and potent family of antitumor antibiotics," Cancer Res. 53:3336-3342 (1993).

Hudson et al., (2003). "Engineered antibodies," Nat. Med., 9:129-134.

Idusogie et al., (2000). "Mapping of the C1q Binding Site on Rituxan, a Chimeric Antibody with a Human IgG1 Fc," J. Immunol.,164:4178-4184.

Imai-Nishiya et al., (2007). "Double knockdown of α1,6-fucosyltransferase (FUT8) and GDP-mannose 4,6-dehydratase (GMD) in antibody-producing cells: a new strategy for generating fully non-fucosylated therapeutic antibodies with enhanced ADCC," BMC Biotechnol., 7:84, 13 pages.

Jefferis et al., (2009). "Human immunoglobulin allotypes: Possible implications for immunogenicity," mAbs, 1(4):332-8.

Jeffrey et al., (2006). "Dipeptide-based highly potent doxorubicin antibody conjugates," Bioorganic & Med. Chem. Letters, 16:358-362.

Jones et al. (1986). "Replacing the complementarity-determining regions in a human antibody with those from a mouse," Nature, 321:522-525.

Kim et al., (1994). "Localization of the site of the murine IgG1 molecule that is involved in binding to the murine intestinal Fc receptor," European Journal of Immunology, 24:2429-2434.

King et al., (2002). "Monoclonal Antibody Conjugates of Doxorubicin Prepared with Branched Peptide Linkers: Inhibition of Aggregation by Methoxytriethyleneglycol Chains," J. Med. Chem., 45:4336-4343.

Klein et al. (2012), "Progress in overcoming the chain association issue in bispecific heterodimeric IgG antibodies," MAbs, 4(6):653-663.

Kontermann et al., (2015). "Bispecific antibodies," Drug Discovery Today, 20(7):838-847.

Kozbor et al., (1984). "A human hybrid myeloma for production of human monoclonal antibodies," J. Immunol., 133:3001-5.

Kratz et al., (2006). "Prodrugs of anthracyclines in cancer chemotherapy," Current Med. Chem. 13:477-523.

Krieg et al. (2010). "Improved IL-2 immunotherapy by selective stimulation of IL-2 receptors on lymphocytes and endothelial cells," PNAS, 107(26):11906-11911.

Lehninger, in Biochemistry, second ed., pp. 73-75, Worth Publishers, New York (1975).

Lindmark et al., (1983). "Binding of immunoglobulins to protein A and immunoglobulin levels in mammalian sera," J. Immunol. Meth., 62:1-13.

Lode et al., (1998). "Targeted Therapy with a Novel Enediyene Antibiotic Calicheamicin θI1 Effectively Suppresses Growth and Dissemination of Liver Metastases in a Syngeneic Model of Murine Neuroblastoma," Cancer Res., 58:2925-2928.

Lonberg, et al. (1994). "Antigen-specific human antibodies from mice comprising four distinct genetic modifications," Nature 368:856-859.

Mather et al., (1982). "Culture of testicular cells in hormone-supplemented serum-free medium," Annals N.Y. Acad. Sci., 383:44-68.

Mather, (1980). "Establishment and characterization of two distinct mouse testicular epithelial cell lines," Biol. Reprod. 23:243-251.

Merchant et al., (1988). "An efficient route to human bispecific IgG," Nat. Biotechnol., 16(7):677-681.

Milstein et al., (1983). "Hybrid hybridomas and their use in immunohistochemistry," Nature, 305:537.

Moore et al. (2011). "A novel bispecific antibody format enables simultaneous bivalent and monovalent co-engagement of distinct target antigens," MAbs., 3(6): 546-557.

Mori et al., (2004). "Engineering Chinese hamster ovary cells to maximize effector function of produced antibodies using FUT8 siRNA," Biotechnol. Bioeng. 88(7):901-908.

Morimoto et al., (1992). "Single-step purification of F(ab')2 fragments of mouse monoclonal antibodies (immunoglobulins G1) by hydrophobic interaction high performance liquid chromatography using TSKgel Phenyl-5PW," Journal of Biochemical and Biophysical Methods, 24:107-117.

Nagy et al., (2000). "Stability of cytotoxic luteinizing hormone-releasing hormone conjugate (AN-152) containing doxorubicin 14-O-hemiglutarate in mouse and human serum in vitro: Implications for the design of preclinical studies," Proc. Natl. Acad. Sci. USA, 97:829-834.

Nilvebrant et al., (2013). "The albumin-binding domain as a scaffold for protein engineering," Comput. Struct. Biotechol. J., 6:e201303009, 8 pages.

Nygren et al., (1988). "Analysis and use of the serum albumin binding domains of streptococcal protein G," J. Mol. Recogn., 1(2):69-74.

Okazaki et al., (2004). "Fucose depletion from human IgG1 oligosaccharide enhances binding enthalpy and association rate between IgG1 and FcgammaRIIIa," J. Mol. Biol., 336:1239-1249.

Omasa et al., (2008). "Decrease in antithrombin III fucosylation by expressing GDP-fucose transporter siRNA in Chinese hamster ovary cells," J. Biosci. Bioeng., 106(2):168-173.

Podust et al., (2016). "Extension of in vivo half-life of biologically active molecules by XTEN protein polymers," J. Controlled Release, 240:52-66.

Proba et al., (1995). "Functional antibody single-chain fragments from the cytoplasm of *Escherichia coli*: influence of thioredoxin reductase (TrxB)," Gene, 159:203-7.

Ramm et al., (2000). "The periplasmic *Escherichia coli* peptidylprolyl cis, trans-isomerase FkpA II. Isomerase-independent chaperone activity in vitro," J. Biol. Chem., 275:17106-17113.

Reyes et al., (1982). "Expression of human β-interferon cDNA under the control of a thymidine kinase promoter from herpes simplex virus," Nature, 297:598-601.

Riechmann et al. (1988). "Reshaping human antibodies for therapy," Nature, 332:323-327.

Ridgway et al., (1996). "'Knobs-into-holes' engineering of antibody CH3 domains for heavy chain heterodimerization," Protein Eng., 9(7):617-621.

Ripka et al., (1986). "Two chinese hamster ovary glycosylation mutants affected in the conversion of GDP-mannose to GDP-fucose," Arch. Biochem. Biophys., 249:533-545.

Roux et al., (1998). "Comparisons of the ability of human IgG3 hinge mutants, IgM, IgE, and IgA2, to form small immune complexes: a role for flexibility and geometry," J Immunol, 161:4083-90.

Sali et al. (2015). "Characterization of a Novel Human-Specific STING Agonist that Elicits Antiviral Activity Against Emerging Alphaviruses," PloS Pathog., 11(12):e1005324, 30 pages.

Schlapschy et al. (2013). "PASylation: a biological alternative to PEGylation for extending the plasma half-life of pharmaceutically active proteins," Protein Eng. Des. Sel., 26(8):489-501.

Shields et al, (2001). "High resolution mapping of the binding site on human IgG1 for Fc gamma RI, Fc gamma RII, Fc gamma RIII,

(56) References Cited

OTHER PUBLICATIONS and FcRn and design of IgG1 variants with improved binding to the Fc gamma R," J. Biol. Chem., 276:6591-6604.

Shields et al., (2002). "Lack of fucose on human IgG1 N-linked oligosaccharide improves binding to human Fcgamma RIII and antibody-dependent cellular toxicity," J. Biol. Chem., 277(30):26733-40.

Shinkawa et al., (2003). "The absence of fucose but not the presence of galactose or bisecting N-acetylglucosamine of human IgG1 complex-type oligosaccharides shows the critical role of enhancing antibody-dependent cellular cytotoxicity," J. Biol. Chem., 278(5):3466-73.

Siebenlist et al., (1980). "*E. coli* RNA polymerase interacts homologously with two different promoters," Cell 20:269-281.

Simmons et al., (2002). "Expression of full-length immunoglobulins in *Escherichia coli*: rapid and efficient production of aglycosylated antibodies," J. Immunol. Methods, 263:133-147.

Sola et al. (2007), "Modulation of protein biophysical properties by chemical glycosylation: biochemical insights and biomedical implications," Cell. Mol. Life Sci., 64(16):2133-2152.

Sola et al., (2009), "Effects of Glycosylation on the Stability of Protein Pharmaceuticals," J. Pharm. Sci., 98(4):1223-1245.

Sties et al. (eds), Basic and Clinical Immunology, 8th Edition, Appleton & Lange, Norwalk, CT, 1994, p. 71 and Chapter 6.

Suresh et al., (1986). "Bispecific monoclonal antibodies from hybrid hybridomas," Methods in Enzymology, 121:210-228.

Tomizuka et al., (2000). "Double trans-chromosomic mice: Maintenance of two individual human chromosome fragments containing Ig heavy and κ loci and expression of fully human antibodies," Proc. Natl. Acad. Sci. USA, 97:722-727.

Torgov et al., (2005). "Generation of an Intensely Potent Anthracycline by a Monoclonal Antibody-β-Galactosidase Conjugate," Bioconj. Chem., 16:717-721.

Traunecker et al., (1991). "Bispecific single chain molecules (Janusins) target cytotoxic lymphocytes on HIV infected cells," EMBO J., 10:3655-3659.

Urlaub et al., (1980). "Isolation of Chinese hamster cell mutants deficient in dihydrofolate reductase activity," Proc. Natl. Acad. Sci. USA, 77:4216-4220.

Verhoeyen et al., (1988). "Reshaping human antibodies: grafting an antilysozyme activity," Science, 239:1534-1536.

Vitetta et al., (1987). "Redesigning nature's poisons to create anti-tumor reagents," Science, 238:1098-1104.

Yamane-Ohnuki et al., (2004). "Establishment of Futb knockout Chinese hamster ovary cells: an ideal host cell line for producing completely defucosylated antibodies with enhanced antibody-dependent cellular cytotoxicity," Biotech. Bioeng., 87:614-22.

Yamane-Ohnuki et al., (2009). "Production of therapeutic antibodies with controlled fucosylation," MAbs, 1(3):230-236.

Yang et al., (2003). "Tailoring structure±function and pharmacokinetic properties of single-chain Fv proteins by site-specific PEGylation," Protein Eng., 16(10):761-770.

Yaniv, (1982). "Enhancing elements for activation of eukaryotic promoters," Nature 297:17-18 (1982).

Yeung et al., (2009). "Engineering Human IgG1 Affinity to Human Neonatal Fc Receptor: Impact of Affinity Improvement on Pharmacokinetics in Primates," J. Immunol., 182:7667-7671.

Zapata et al., (1995). "Engineering linear F(ab')2 fragments for efficient production in *Escherichia coli* and enhanced antiproliferative activity," Protein Eng., 8(10):1057-1062.

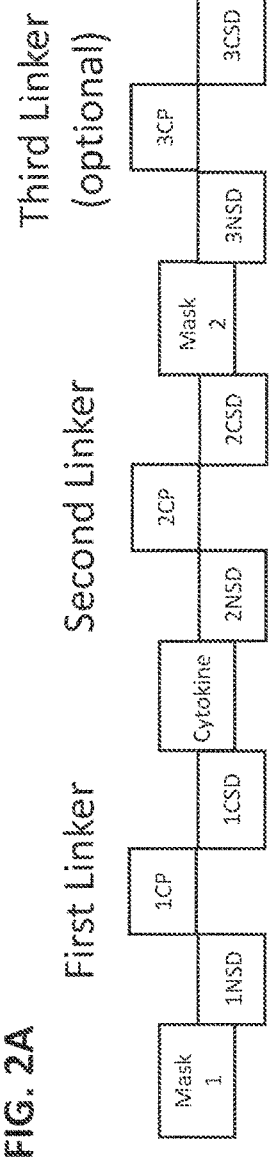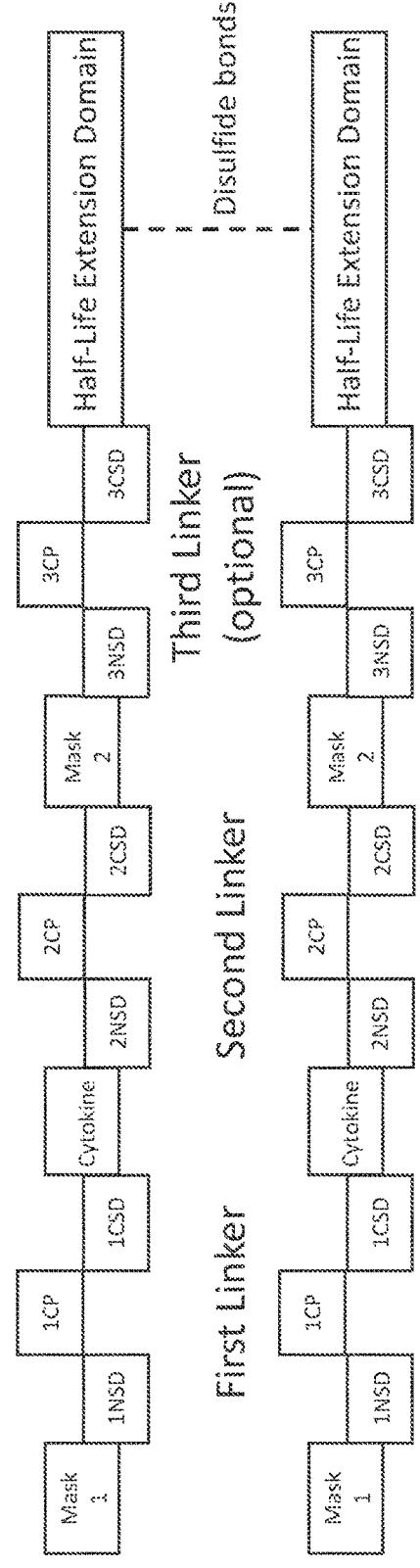
FIG. 2A
FIG. 2B

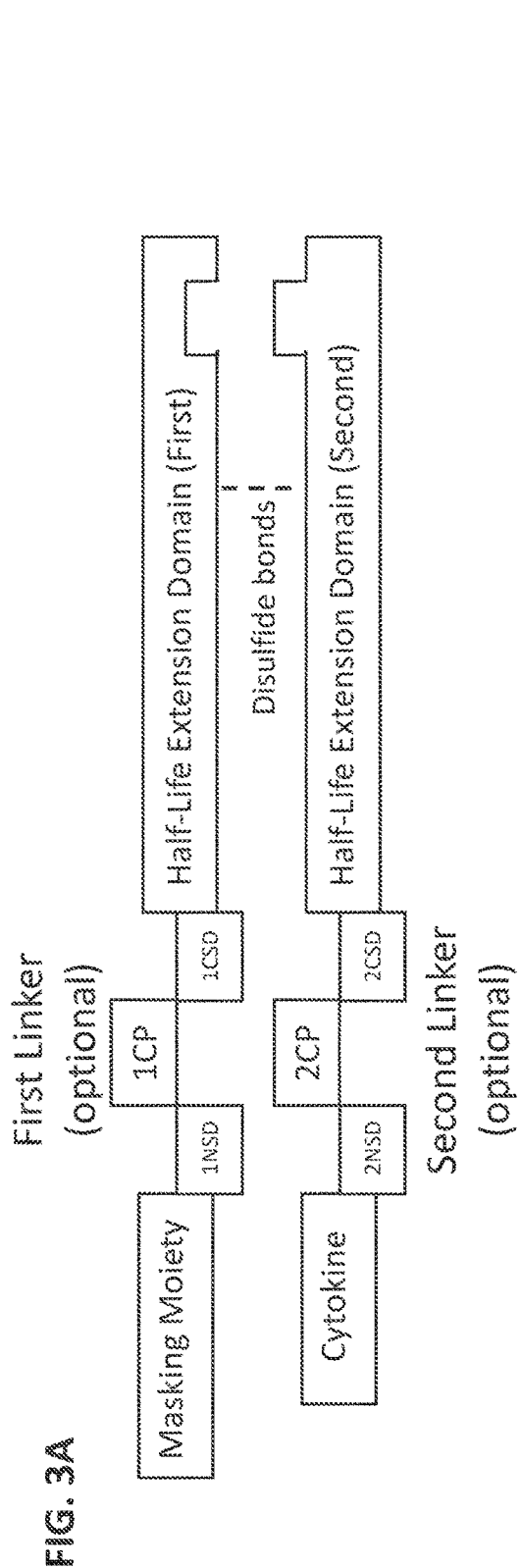
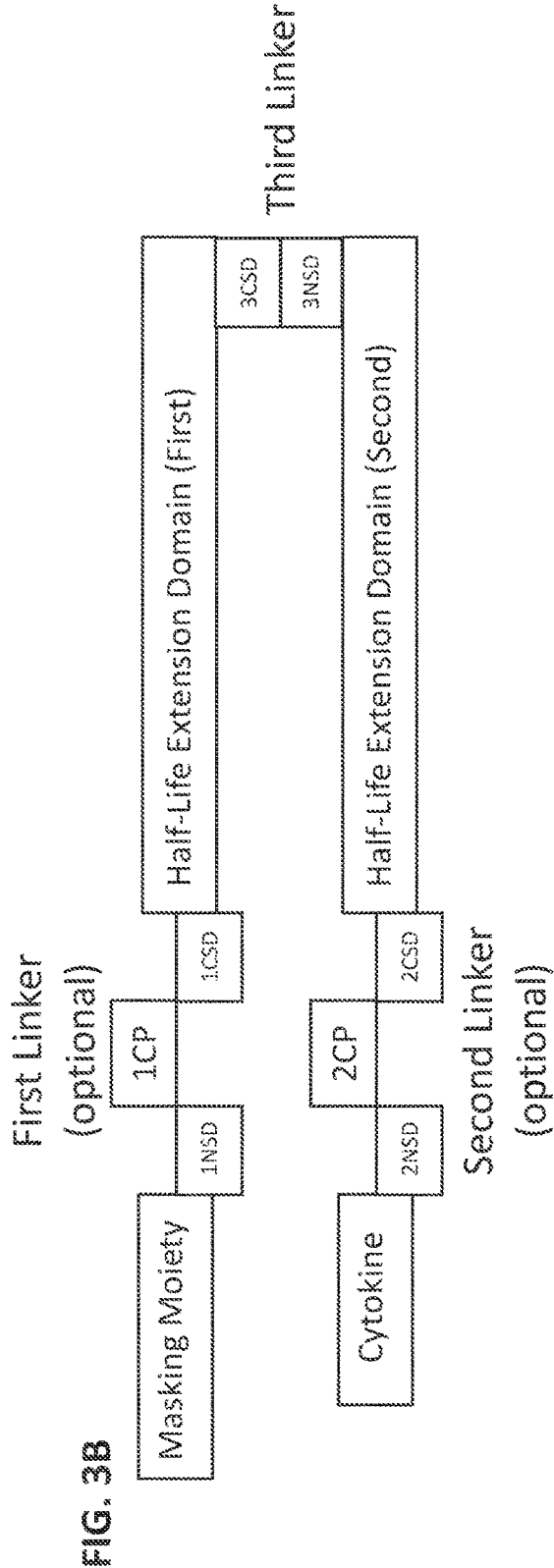
FIG. 3A
FIG. 3B

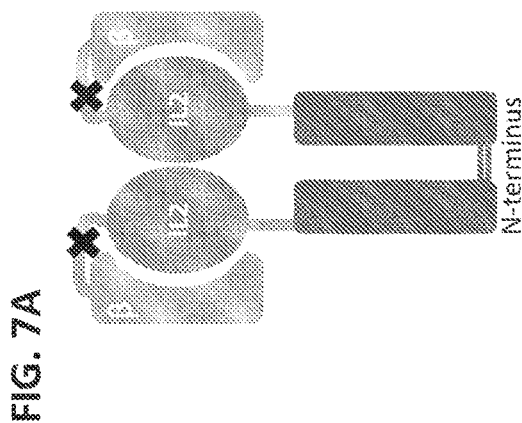
FIG. 7A
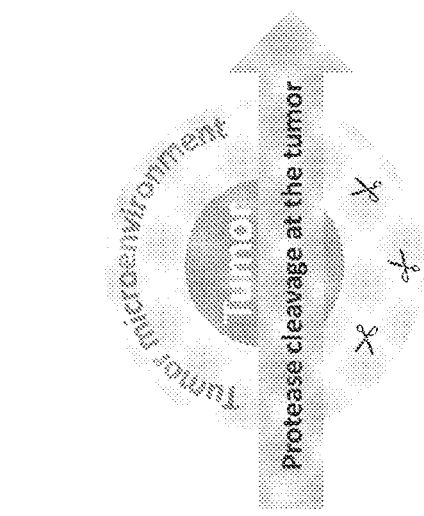
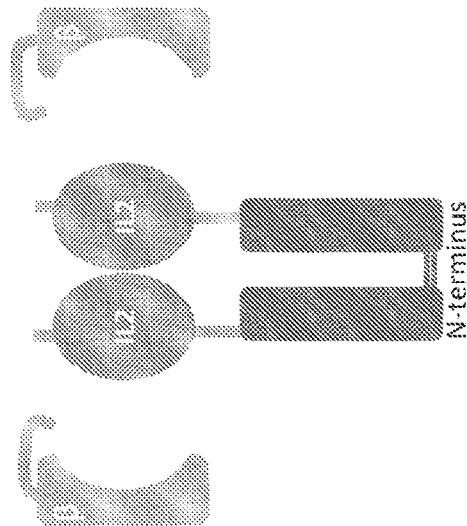
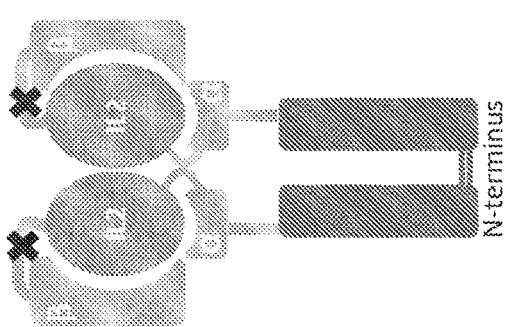
FIG. 7B
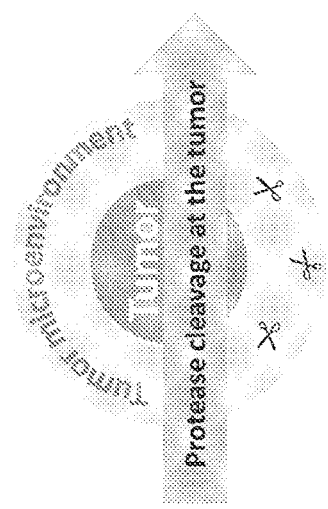
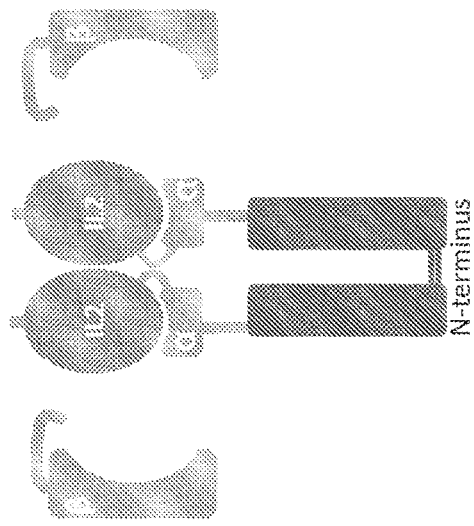

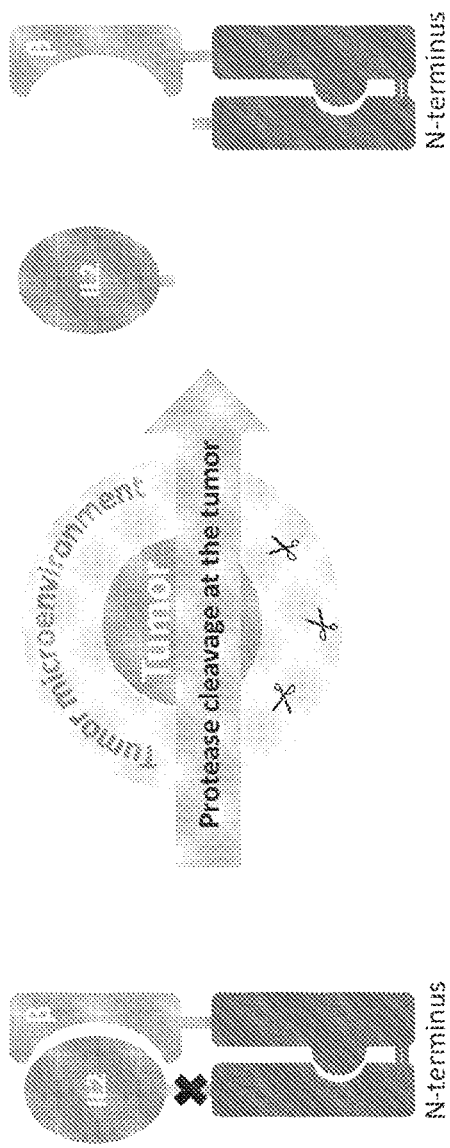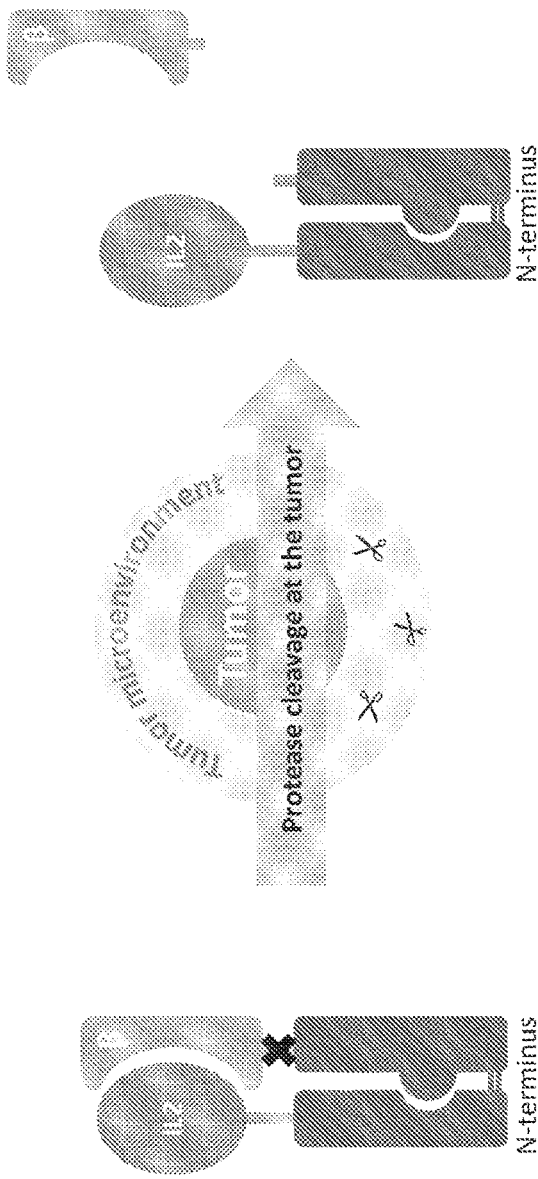
FIG. 7C
FIG. 7D

| Sample | ka (1/(M*s)) | kd (1/s) | KD | Chi2 | U-value: kd (%) |
|---|---|---|---|---|---|
| AK215 | ND | ND | ND | ND | ND |
| AK216 | ND | ND | ND | ND | ND |
| rhIL2 | 8.61e+5 | 1.04e-3 | 1.21 nM | 4.86 | 1.2 |

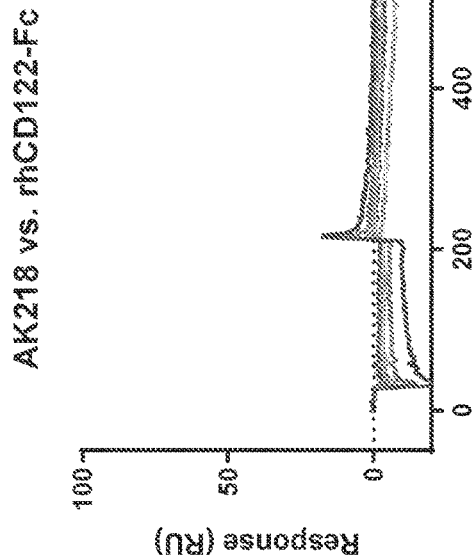
FIG. 10A AK216 vs. rhCD122-Fc
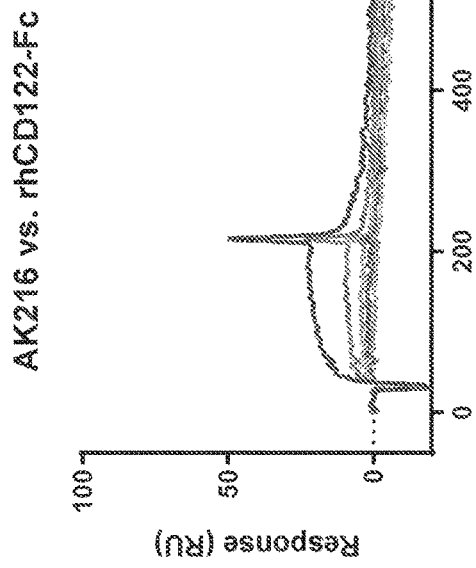
FIG. 10C rhIL2 vs. rhCD122-Fc
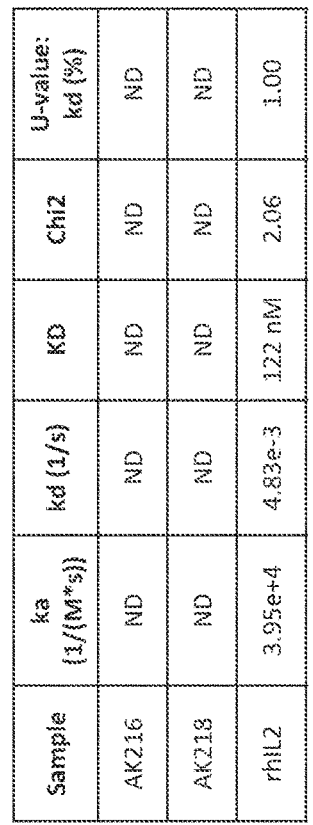
FIG. 10B AK218 vs. rhCD122-Fc
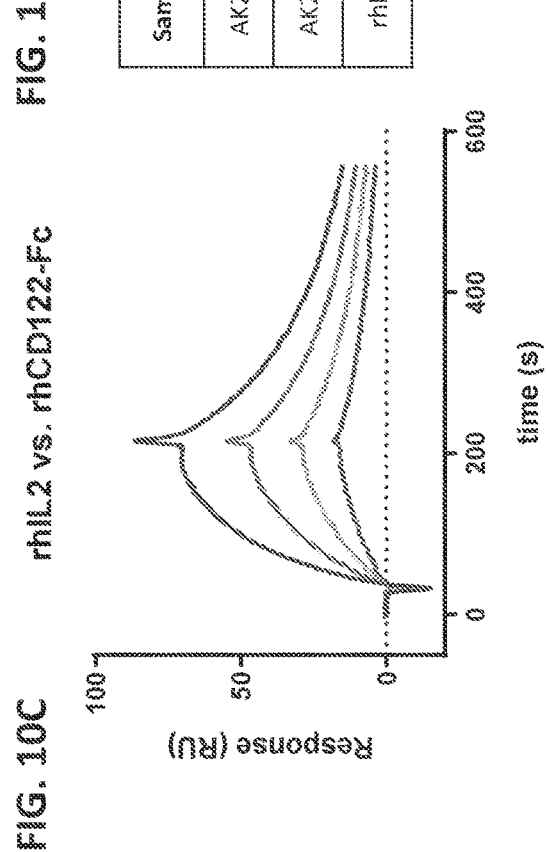
FIG. 10D
| Sample | ka (1/(M*s)) | kd (1/s) | KD | Chi2 | U-value: kd (%) |
|---|---|---|---|---|---|
| AK216 | ND | ND | ND | ND | ND |
| AK218 | ND | ND | ND | ND | ND |
| rhIL2 | 3.95e+4 | 4.83e-3 | 122 nM | 2.06 | 1.00 |

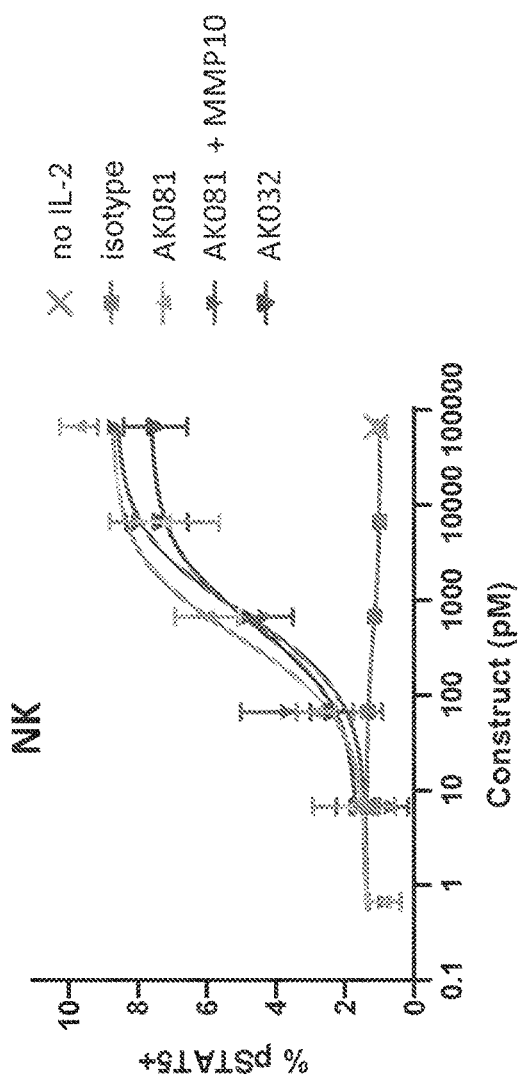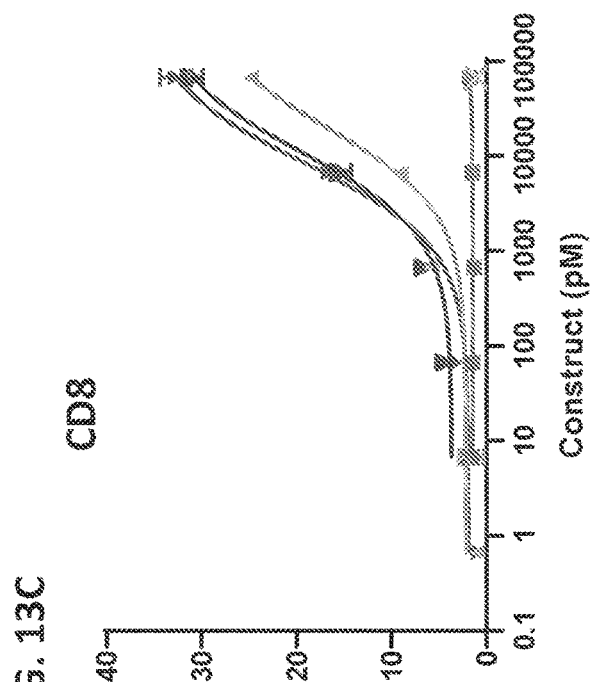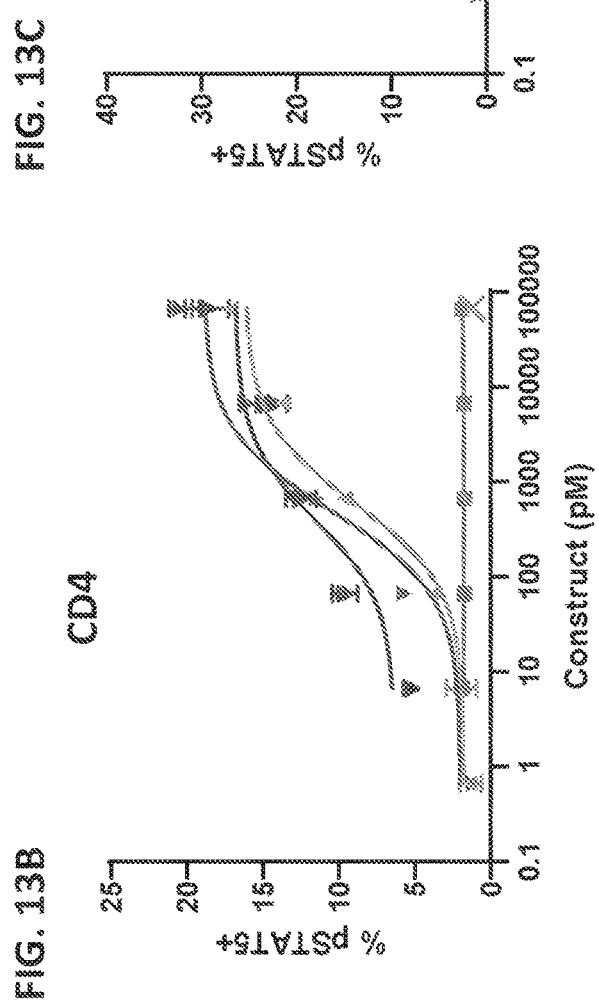
FIG. 13A
FIG. 13B
FIG. 13C

| Construct | FoxP3+ T_reg | | CD4+ T_help | | CD8+ T_cyto | |
|---|---|---|---|---|---|---|
| | EC$_{50}$ (pM) | Fold-change | EC$_{50}$ (pM) | Fold-change | EC$_{50}$ (pM) | Fold-change |
| rhIL-2 | 1.1 | | 1040 | | 185 | |
| AK081 | 4.1 | 3.7 | 19600 | 18.8 | 322 | 1.7 |
| AK111 | 26.4 | 24.0 | 1490* | 1.4* | 616 | 3.3 |

*Prism was able to find a best-fit value, but was unable to calculate a complete confidence interval. This best-fit value should be interpreted with caution.

| Construct | FoxP3+ T$_{reg}$ | | CD4+ T$_{help}$ | | CD8+ T$_{cyto}$ | |
|---|---|---|---|---|---|---|
| | EC$_{50}$ (pM) | Fold-change | EC$_{50}$ (pM) | Fold-change | EC$_{50}$ (pM) | Fold-change |
| rhIL-2 | 1.1 | | 1040 | | 190 | |
| AK167 | 13700 | 12455 | 56900 | 55 | 155000 | 816 |
| AK168 | n.d. | | n.d. | | n.d. | |

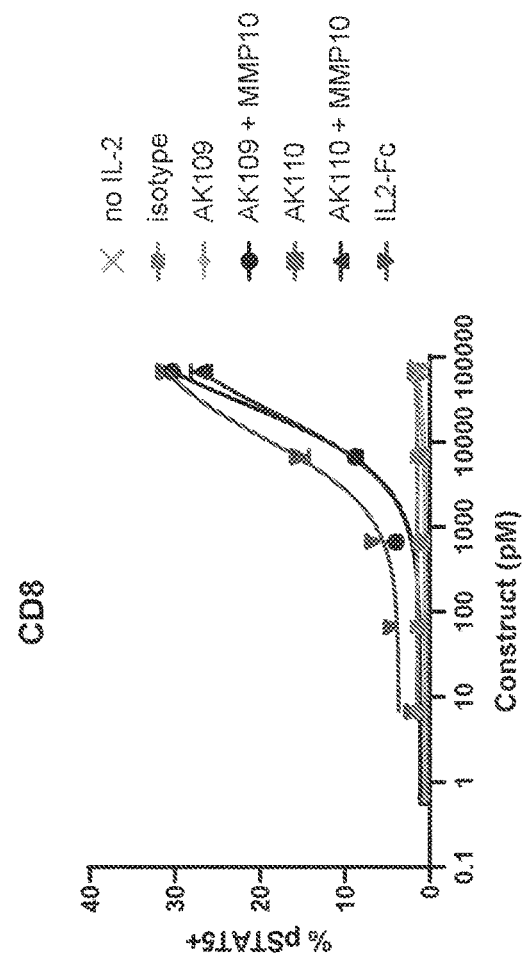
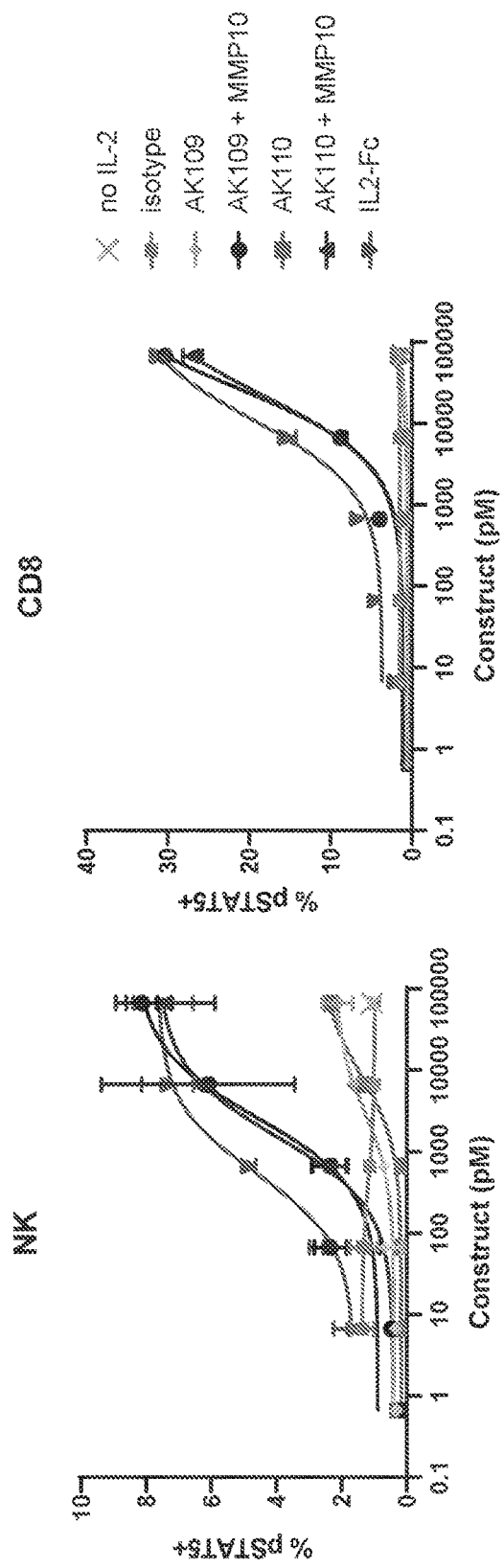
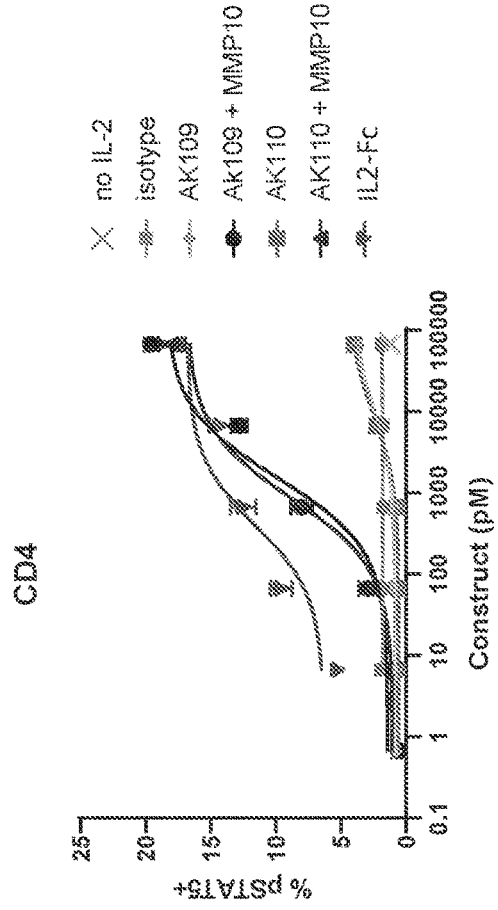
FIG. 17A
FIG. 17B
FIG. 17C

| Construct | CD3+ CD4+ FoxP3+ EC$_{50}$ (pM) | CD3+ CD4+ FoxP3− EC$_{50}$ (pM) | CD3+ CD8+ EC$_{50}$ (pM) |
|---|---|---|---|
| rhIL-2 | 1.94 | 247 | 2300 |
| AK211 | 39500 | * | 164000 |
| AK253 | 15400 | 75100 | 46400 |
| AK235 | 19200 | 69500 | 44100 |
| AK314 | 7250 | 49400 | 29500 |
| AK306 | 5680 | 56300 | 28800 |
| AK310 | 373 | 20800 | 22300 |
| AK316 | 1.73 | 331 | 167000** |

| Construct | FoxP3+ Treg EC50 (pM) | CD4+ Thelp EC50 (pM) | CD8+ Tcyto EC50 (pM) |
|---|---|---|---|
| rhIL-2 | 1.67 | 154 | 2710 |
| AK081 | 3.59 | 332 | 6700 |
| AK167 | 4390 | 22900 | 13200 |
| AK215 | 1020 | 9200 | 5490 |
| AK218 | 86.7 | 5270 | 7550 |
| AK219 | 117 | 5030 | 4570 |
| AK220 | 782 | 10900 | 7650 |
| AK223 | 3040 | 20200 | 12600 |

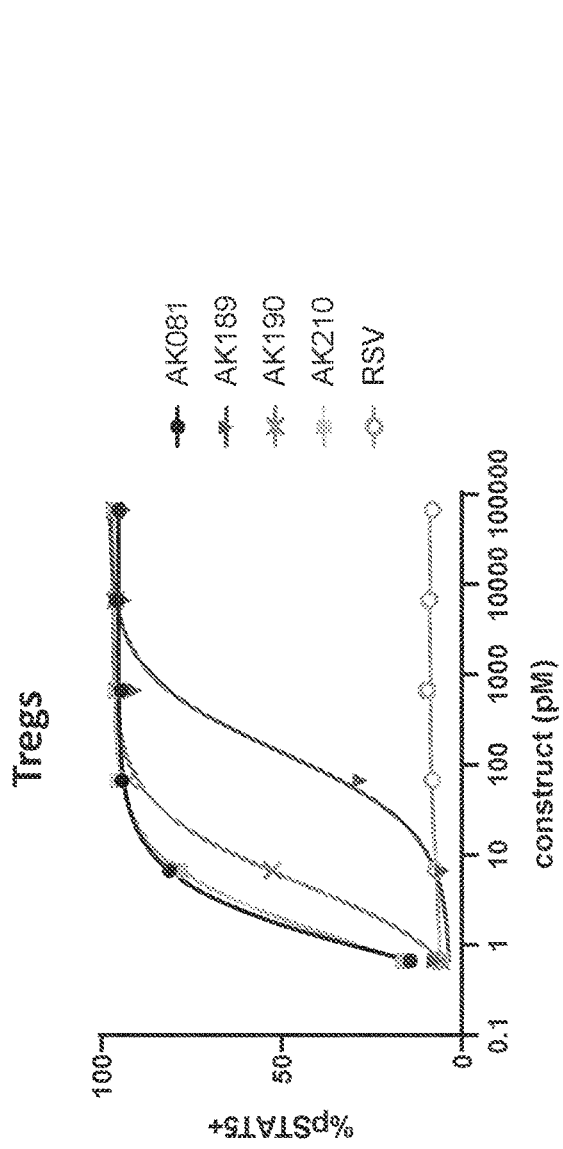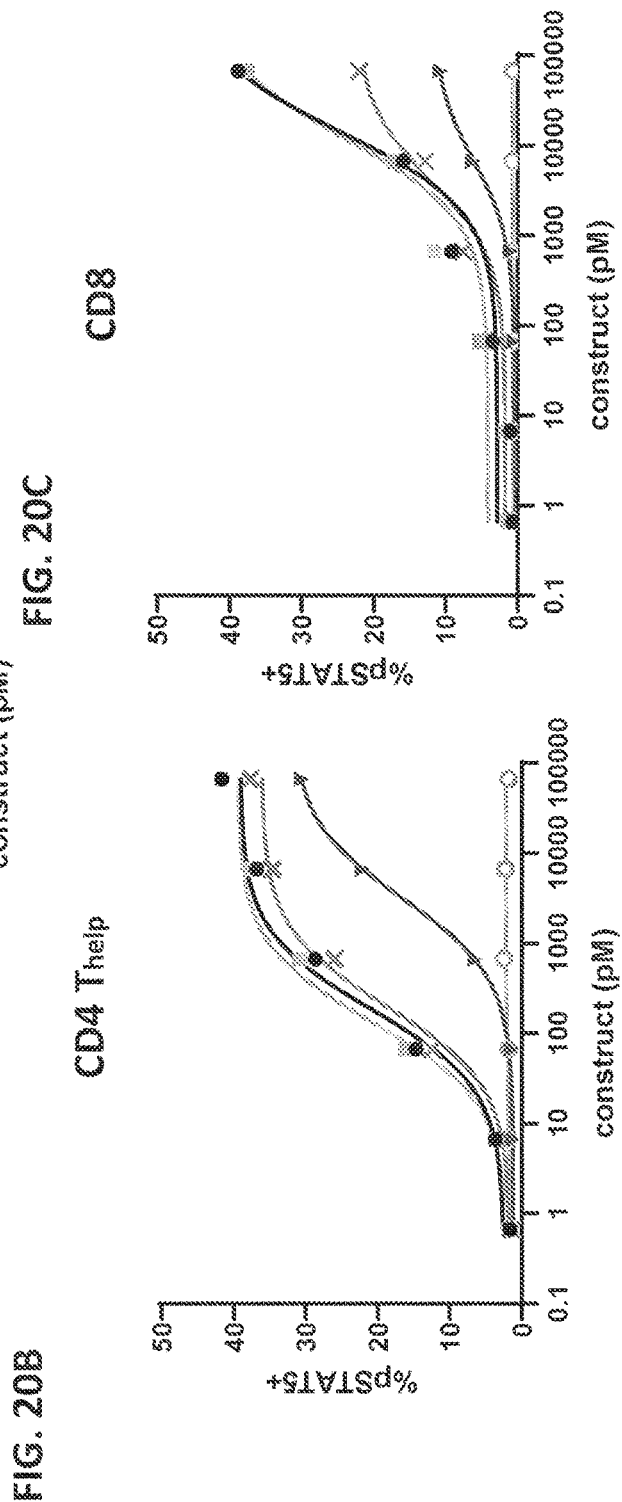
FIG. 20A
FIG. 20B
FIG. 20C

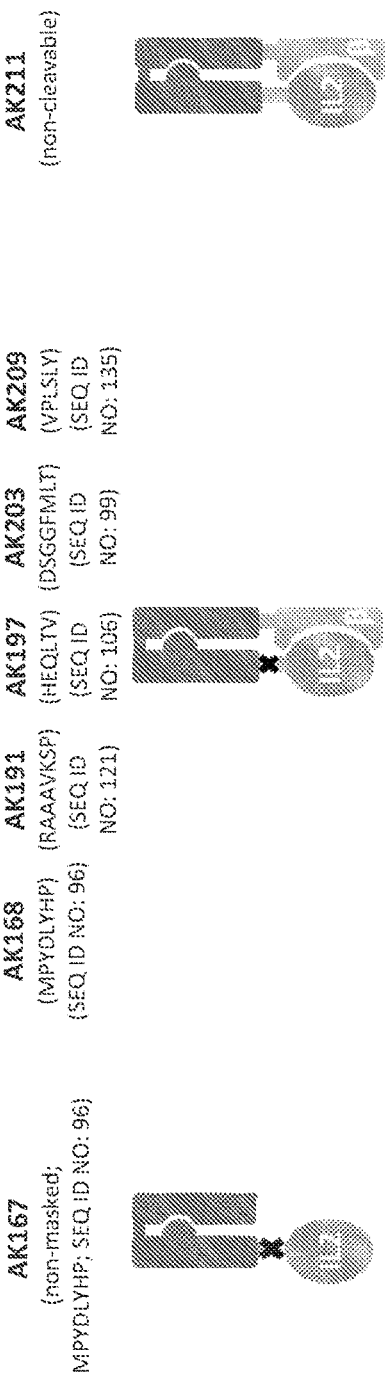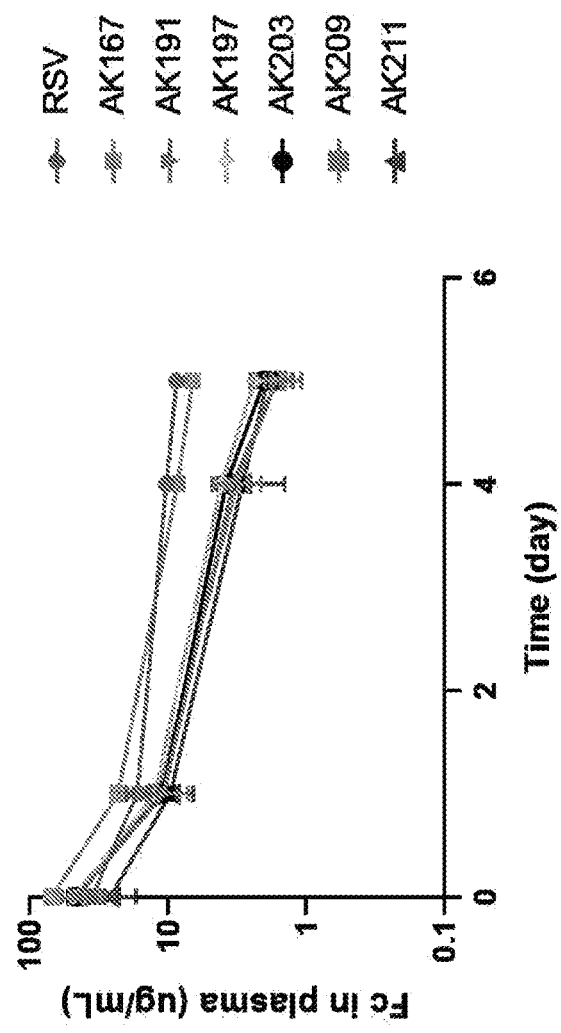
FIG. 24A
FIG. 24B

FIG. 26A Spleen CD8
FIG. 26B Spleen CD4
FIG. 26C Spleen NK
FIG. 26D Spleen Treg (Foxp3)

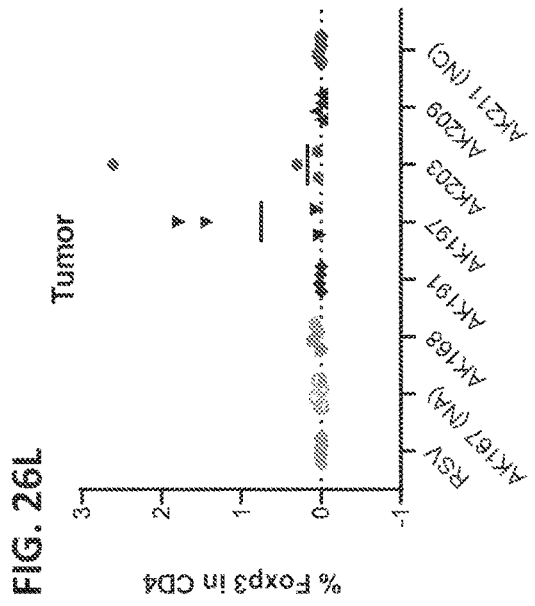
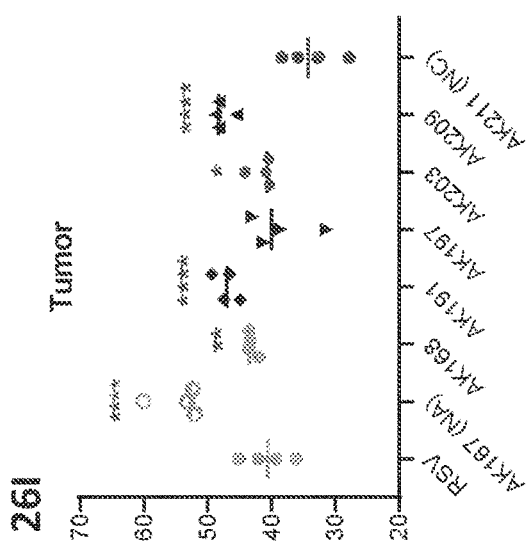
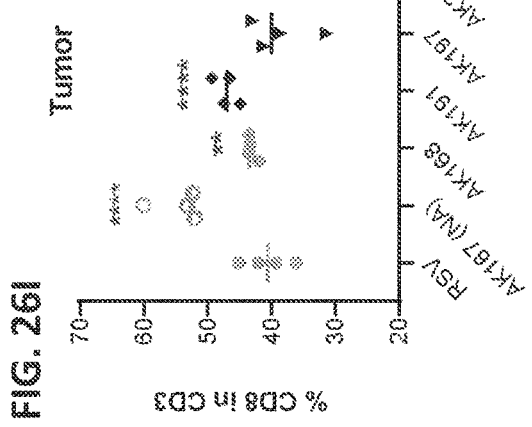
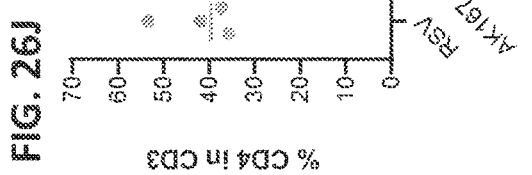
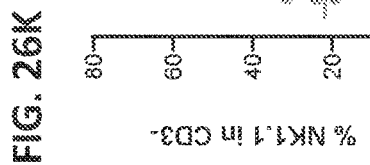
FIG. 26I  FIG. 26J  FIG. 26K  FIG. 26L

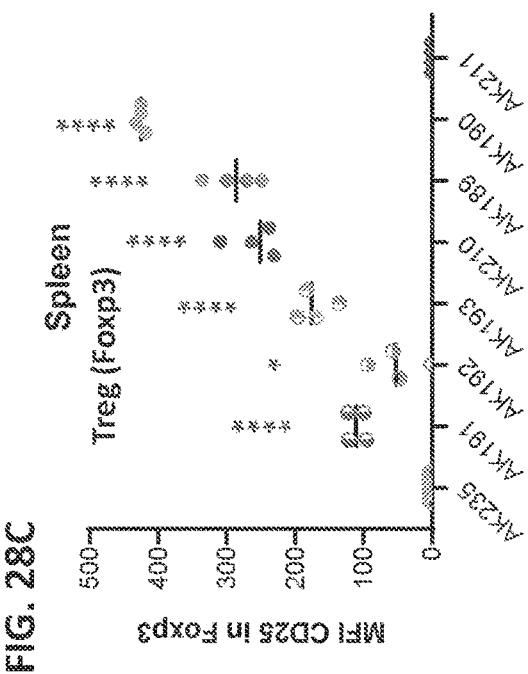
FIG. 28A, FIG. 28B, FIG. 28C

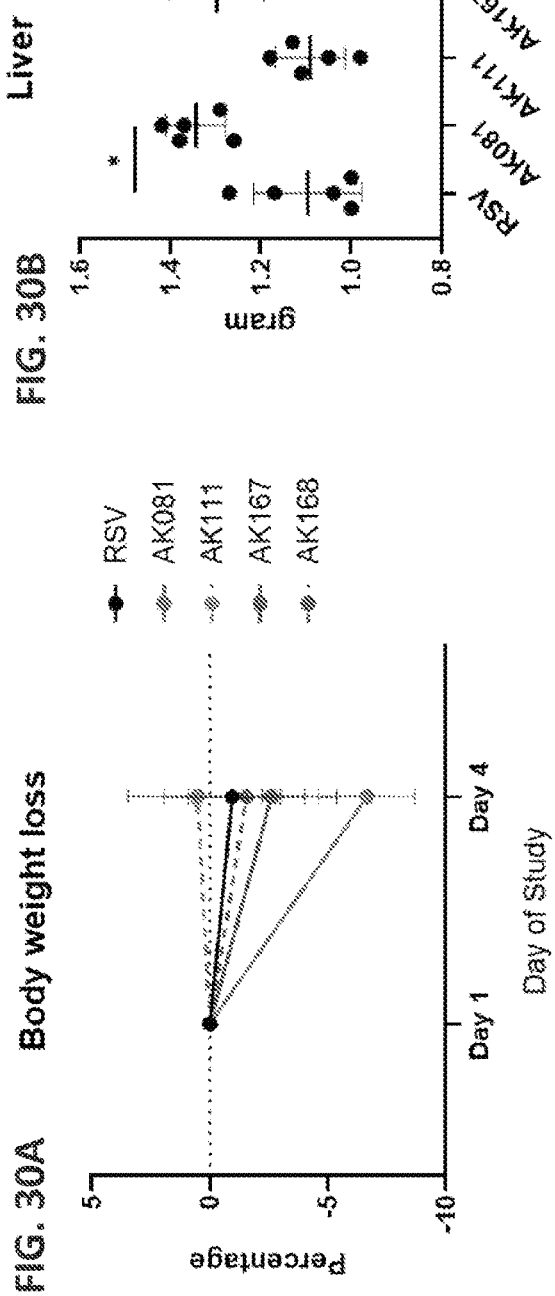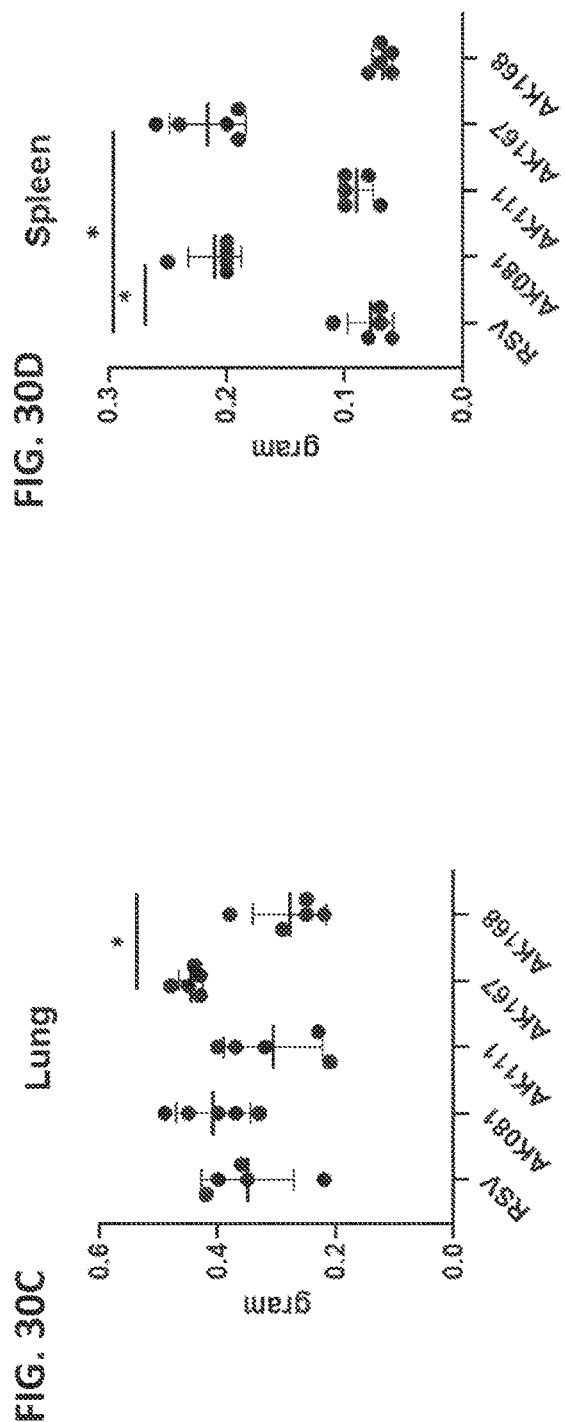

MASKED CYTOKINE POLYPEPTIDES

CROSS-REFERENCE TO RELATED APPLICATIONS

This application is a continuation of International Application No. PCT/US2019/053588, filed on Sep. 27, 2019, which claims priority to U.S. Provisional Application No. 62/737,803, filed Sep. 27, 2018, U.S. Provisional Application No. 62/888,276, filed Aug. 16, 2019, and U.S. Provisional Application No. 62/891,199, filed Aug. 23, 2019, the contents of each of which are incorporated herein by reference in their entirety for all purposes.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 737762000901SEQLIST.TXT, date recorded: Aug. 19, 2020, size: 1,000 KB).

FIELD

This invention relates to masked cytokines and methods related to the use and manufacture of the same.

BACKGROUND

Cancer is the second leading cause of death in the United States, accounting for more deaths than the next five leading causes (chronic respiratory disease, stroke, accidents, Alzheimer's disease and diabetes). While great strides have been made especially with targeted therapies, there remains a great deal of work to do in this space Immunotherapy and a branch of this field, immuno-oncology, is creating viable and exciting therapeutic options for treating malignancies. Specifically, it is now recognized that one hallmark of cancer is immune evasion and significant efforts have identified targets and developed therapies to these targets to reactivate the immune system to recognize and treat cancer.

Cytokine therapy is an effective strategy for stimulating the immune system to induce anti-tumor cytotoxicity. For example, aldesleukin, a recombinant form of interleukin-2 (IL-2), has been approved by the FDA for the treatment of metastatic renal cell carcinoma and melanoma. Unfortunately, cytokines that are administered to patients generally have a very short half-life, thereby requiring frequent dosing. For instance, the product label of aldesleukin, marketed under the brand name Proleukin, states that the drug was shown to have a half-life of 85 minutes in patients who received a 5-minute intravenous (IV) infusion. In addition, administration of high doses of cytokine can cause adverse health outcomes, such as vascular leakage, through systemic immune activation. These findings illustrate the need for developing cytokine therapeutics that effectively target tumors without the side effects associated with systemic immune activation. Provided herein are masked cytokines, compositions thereof and methods of use thereof for addressing this need.

All references cited herein, including patent applications, patent publications, and scientific literature, are herein incorporated by reference in their entirety, as if each individual reference were specifically and individually indicated to be incorporated by reference.

SUMMARY

The disclosed invention relates to the engineering and use of masked cytokines or functional fragments thereof that, in some embodiments, are engineered to be masked by a masking moiety at one or more receptor binding site(s) of the cytokine or functional fragment thereof. In some embodiments, the cytokines are engineered to be activatable by a protease at a target site, such as in a tumor microenvironment, by including a proteolytically cleavable linker. In some embodiments, the proteolytically cleavable linker links the cytokine to the masking moiety, links the cytokine to a half-life extension domain, and/or links the masking moiety to a half-life extension domain. The masking moiety blocks, occludes, inhibits (e.g., decreases) or otherwise prevents (e.g., masks) the activity or binding of the cytokine to its cognate receptor or protein. Upon proteolytic cleavage of the cleavable linker at the target site, the cytokine becomes activated, which renders it capable of binding to its cognate receptor or protein with increased affinity.

One embodiment comprises a masked cytokine comprising a masking moiety; and a cytokine or functional fragment thereof, wherein the masking moiety is linked to the cytokine or functional fragment thereof via a linker. In one aspect, the masked cytokine further comprises a half-life extension domain that is linked to either the masking moiety or the cytokine or functional fragment thereof.

In one embodiment, the masked cytokine comprises in an N to C-terminal or in a C to N-terminal direction: a) a masking moiety; b) a first linker; c) a cytokine or functional fragment thereof; and d) a half-life extension domain. In another embodiment, the masked cytokine comprises in an N to C-terminal or in a C to N-terminal direction: a) a masking moiety; b) a first linker; c) a cytokine or functional fragment thereof; d) a second linker and e) a half-life extension domain. In another embodiment, the masked cytokine comprises in an N to C-terminal or in a C to N-terminal direction: a) a cytokine or functional fragment thereof; b) a first linker; c) a masking moiety; and d) a half-life extension domain.

In another embodiment, the masked cytokine comprises in an N to C-terminal or in a C to N-terminal direction: a) a cytokine or functional fragment thereof; b) a first linker; c) a masking moiety; d) a second linker; and e) a half-life extension domain.

In one embodiment, the cytokine or functional fragment thereof is an IL-2 polypeptide or functional fragment thereof or an IL-15 polypeptide or functional fragment thereof.

In one embodiment, the masked cytokine one or more amino acid substitutions into the amino acid sequence of the IL-2 or IL-15 polypeptide or functional fragment thereof. In one embodiment, the amino acid substitutions reduce the affinity of the IL-2 polypeptide or functional fragment thereof for CD25 (IL-2Rα).

In one embodiment, the IL-2 polypeptide or functional fragment thereof comprises an amino acid sequence produced by introducing one or more amino acid substitutions into the amino acid sequence of the IL-2 polypeptide or functional fragment thereof that increases the affinity of the IL-2 polypeptide or functional fragment thereof for IL-2Rβ or IL-2Rγ.

In one embodiment, the half-life extension domain is an antibody or fragment thereof, and in some embodiments, one or more amino acid substitutions altering effector function.

In one embodiment, the antibody or fragment thereof is a Fragment crystallizable domain (Fc domain) or fragment thereof.

In one embodiment, the half-life extension domain is a polyamino acid sequence, such as a PAS polypeptide or an XTEN polypeptide.

In one embodiment the masked cytokine comprises a second masking moiety, wherein the second masking moiety is linked to the cytokine or functional fragment thereof via a second linker.

In one embodiment, the masked cytokine comprises in an N to C-terminal or in a C to N-terminal direction: a) a first masking moiety; b) a first linker; c) a cytokine or functional fragment thereof; d) a second linker; e) a second masking moiety; and f) a half-life extension domain.

In one embodiment, the masked cytokine comprises in an N to C-terminal or in a C to N-terminal direction: a) a first masking moiety; b) a first linker; c) a cytokine or functional fragment thereof; d) a second linker; e) a second masking moiety; f) a third linker; and g) a half-life extension domain.

In one embodiment, the masked cytokine comprises in an N to C-terminal or in a C to N-terminal direction: a) a second masking moiety; b) a second linker; c) a cytokine or functional fragment thereof; d) a first linker; e) a first masking moiety; and f) a half-life extension domain.

In one embodiment, the masked cytokine comprises in an N to C-terminal or in a C to N-terminal direction: a) a second masking moiety; b) a second linker; c) a cytokine or functional fragment thereof; d) a first linker; e) a first masking moiety; f) a third linker; and g) a half-life extension domain.

In one embodiment, the half-life extension domain is an albumin polypeptide or functional fragment thereof.

In one embodiment, the cleavable peptide is cleaved by one or more enzyme selected from the group consisting of: ABHD12, ADAM12, ABHD12B, ABHD13, ABHD17A, ADAM19, ADAM20, ADAM21, ADAM28, ADAM30, ADAM33, ADAM8, ABHD17A, ADAMDEC1, ADAMTS1, ADAMTS10, ADAMTS12, ADAMTS13, ADAMTS14, ADAMTS15, ADAMTS16, ADAMTS17, ADAMTS18, ADAMTS19, ADAMTS2, ADAMTS20, ADAMTS3, ADAMTS4, ABHD17B, ADAMTS5, ADAMTS6, ADAMTS7, ADAMTS8, ADAMTS9, ADAMTSL1, ADAMTSL2, ADAMTSL3, ABHD17C, ADAMTSL5, ASTL, BMP1, CELA1, CELA2A, CELA2B, CELA3A, CELA3B, ADAM10, ADAM15, ADAM17, ADAM9, ADAMTS4, CTSE, CTSF, ADAMTSL4, CMA1, CTRB1, CTRC, CTSO, CTR1, CTSA, CTSW, CTSB, CTSC, CTSD, ESP1, CTSG, CTSH, GZMA, GZMB, GZMH, CTSK, GZMM, CTSL, CTSS, CTSV, CTSZ, HTRA4, KLK10, KLK11, KLK13, KLK14, KLK2, KLK4, DPP4, KLK6, KLK7, KLKB1, ECE1, ECE2, ECEL1, MASP2, MEP1A, MEP1B, ELANE, FAP, GZMA, MMP11, GZMK, HGFAC, HPN, HTRA1, MMP11, MMP16, MMP17, MMP19, HTRA2, MMP20, MMP21, HTRA3, HTRA4, KEL, MMP23B, MMP24, MMP25, MMP26, MMP27, MMP28, KLK5, MMP3, MMP7, MMP8, MMP9, LGMN, LNPEP, MASP1, PAPPA, PAPPA2, PCSK1, NAPSA, PCSK5, PCSK6, MME, MMP1, MMP10, PLAT, PLAU, PLG, PRSS1, PRSS12, PRSS2, PRSS21, PRSS3, PRSS33, PRSS4, PRSS55, PRSS57, MMP12, PRSS8, PRSS9, PRTN3, MMP13, MMP14, ST14, TMPRSS10, TMPRSS11A, TMPRSS11D, TMPRSS11E, TMPRSS11F, TMPRSS12, TMPRSS13, MMP15, TMPRSS15, MMP2, TMPRSS2, TMPRSS3, TMPRSS4, TMPRSS5, TMPRSS6, TMPRSS7, TMPRSS9, NRDC, OVCH1, PAMR1, PCSK3, PHEX, TINAG, TPSAB1, TPSD1, and TPSG1.

In one embodiment, the half-life extension domain is conjugated to an agent, such as an inhibitor of tubulin polymerization, a DNA damaging agent, or a DNA synthesis inhibitor, a maytansinoid, an auristatin, a pyrrolobenzodiazepine (PBD) dimer, a calicheamicin, a duocarmycin, a indo-linobenzodiazepine dimer or exatecan derivative Dxd.

In one embodiment, the half-life extension domain is conjugated to an immune stimulant, such as a stimulator of interferon genes (STING) agonist, such as a cyclic dinucleotide (CDN), such as cGAMP, c-di-AMP, c-di-GMP, cAIMP, c-di-IMP, or 4-(2-chloro-6-fluorobenzyl)-N-(furan-2-ylmethyl)-3-oxo-3,4-dihydro-2H-benzo[b][1,4]thiazine-6-carboxamide or a toll-like receptor (TLR) agonist, such as TLR1, TLR2, TLR3, TLR4, TLR5, TLR6, TLR7, TLR8, TLR9, or TLR10.

In one embodiment, the masked cytokine comprises a first half-life extension domain and a second half-life extension domain, wherein the masking moiety is linked to the first half-life extension domain, and wherein the cytokine or functional fragment thereof is linked to the second half-life extension domain, In one embodiment, the first half-life extension domain and the second half-life extension domain contain modifications promoting the association of the first and the second half-life extension domain.

One embodiment comprises a nucleic acid encoding the masked cytokines described herein. Another embodiment encompasses a vector comprising the nucleic acid. In another embodiment a host cell comprising the nucleic acid. Another embodiment comprises one or more nucleic acids encoding the masked cytokines described herein. Another embodiment encompasses a vector comprising the one or more nucleic acids. Another embodiment encompasses one or more vectors comprising the one or more nucleic acids.

In another embodiment is provided a method of producing a masked cytokine comprising culturing the host cell under a condition that produces the masked cytokine. In one embodiment, the masked cytokine produced by the host cell is recovered. One embodiment encompasses a masked cytokine produced by the disclosed methods.

In one embodiment, a composition comprising a disclosed masked cytokine is provided. In another embodiment, the composition further comprises an anti-inflammatory agent or an anti-cancer agent, such as a PD-1 inhibitor, an EGFR inhibitor, a HER2 inhibitor, a VEGFR inhibitor, a CTLA-4 inhibitor, a BTLA inhibitor, a B7H4 inhibitor, a B7H3 inhibitor, a CSFIR inhibitor, an HVEM inhibitor, a CD27 inhibitor, a KIR inhibitor, an NKG2A inhibitor, an NKG2D agonist, a TWEAK inhibitor, an ALK inhibitor, a CD52 targeting antibody, a CCR4 targeting antibody, a PD-L1 inhibitor, a KIT inhibitor, a PDGFR inhibitor, a BAFF inhibitor, an HDAC inhibitor, a VEGF ligand inhibitor, a CD19 targeting molecule, a FOLR1 targeting molecule, a DLL3 targeting molecule, a DKK1 targeting molecule, a MUC1 targeting molecule, a MUC16 targeting molecule, a PSMA targeting molecule, an MSLN targeting molecule, an NY-ES0-1 targeting molecule, a B7H3 targeting molecule, a B7H4 targeting molecule, a BCMA targeting molecule, a CD29 targeting molecule, a CD151 targeting molecule, a CD123 targeting molecule, a CD33 targeting molecule, a CD37 targeting molecule, a CDH19 targeting molecule, a CEA targeting molecule, a Claudin 18.2 targeting molecule, a CLEC12A targeting molecule, an EGFRVIII targeting molecule, an EPCAM targeting molecule, an EPHA2 targeting molecule, an FCRH5 targeting molecule, an FLT3 targeting molecule, a GD2 targeting molecule, a glypican 3 targeting molecule, a gpA33 targeting molecule, a GPRC5D targeting molecule, an IL-23R targeting molecule, an IL-1RAP targeting molecule, a MCSP targeting molecule, a RON targeting molecule, a ROR1 targeting molecule, a STEAP2 targeting molecule, a TfR targeting molecule, a CD166 targeting molecule, a TPBG targeting molecule, a TROP2 targeting molecule, a proteasome inhibitor, an ABL inhibitor, a CD30 inhibitor, a FLT3 inhibitor, a MET inhibitor, a RET inhibitor, an IL-1β inhibitor, a MEK inhibitor, a ROS1 inhibitor, a BRAF inhibitor, a CD38 inhibitor, a RANKL inhibitor, a B4GALNT1 inhibitor, a SLAMF7 inhibitor, an IDH2 inhibitor, an mTOR inhibitor, a CD20 targeting antibody, a BTK inhibitor, a PI3K inhibitor, a FLT3 inhibitor, a PARP inhibitor, a CDK4 inhibitor, a CDK6 inhibitor, an FGFR inhibitor, a RAF inhibitor, a JAK1 inhibitor, a JAK2 inhibitor, a JAK3 inhibitor, an IL-6 inhibitor, a IL-17 inhibitor, a Smoothened inhibitor, an IL-6R inhibitor, a BCL2 inhibitor, a PTCH inhibitor, a PIGF inhibitor, a TGFB inhibitor, a CD28 agonist, a CD3 agonist, CD40 agonist, a GITR agonist, a OX40 agonist, a VISTA agonist, a CD137 agonist, a LAG3 inhibitor, a TIM3 inhibitor, a TIGIT inhibitor, or an IL-2R inhibitor.

In one embodiment, the anti-inflammatory agent is a cyclooxygenase (COX) inhibitor, such as a COX-1 and/or COX-2 inhibitor, such as SC-560, FR122047, P6, mofezolac, TFAP, flurbiprofen, ketoprofen, celecoxib, rofecoxib, meloxicam, piroxicam, deracoxib, parecoxib, valdecoxib, etoricoxib, a chromene derivative, a chroman derivative, N-(2-cyclohexyloxynitrophenyl) methane sulfonamide, parecoxib, lumiracoxib, RS 57067, T-614, BMS-347070, JTE-522, S-2474, SVT-2016, CT-3, ABT-963, SC-58125, nimesulide, flosulide, NS-398, L-745337, RWJ-63556, L-784512, darbufelone, CS-502, LAS-34475, LAS-34555, S-33516, diclofenac, mefenamic acid, SD-8381, ibuprofen, naproxen, ketorolac, indomethacin, aspirin, naproxen, tolmetin, piroxicam, or meclofenamate.

In one embodiment, the anti-inflammatory agent is an NF-κB inhibitor, such as an IKK complex inhibitor, an IκB degradation inhibitor, an NF-κB nuclear translocation inhibitor, a p65 acetylation inhibitor, an NF-κB DNA binding inhibitor, an NF-κB transactivation inhibitor, or a p53 induction inhibitor.

In one embodiment, the NF-κB inhibitor is TPCA-1, NF-κB Activation Inhibitor VI (BOT-64), BMS-345541, amlexanox, SC-514 (GK-01140), IMD-0354, IKK-16, BAY-11-7082, MG-115, MG-132, lactacystin, epoxomicin, parthenolide, carfilzomib, MLN-4924 (pevonedistat), JSH-23 rolipram, gallic acid, anacardic acid, GYY-4137, p-XSC, CV-3988, prostaglandin E2 (PGE2), LY-294002, wortmannin, mesalamine, quinacrine, or flavopiridol.

One embodiment encompasses a pharmaceutical composition comprising a disclosed masked cytokine and a pharmaceutically acceptable carrier.

Another embodiment encompasses a kit comprising the disclosed masked cytokine.

Another embodiment comprises a method of treating or preventing a neoplastic disease in a subject, the method comprising administering to the subject an effective amount of a disclosed masked cytokine composition for the treatment of a disease or condition, such as a neoplastic disease, for example, cancer. In one embodiment the cancer is leukemia, lymphoma, head and neck cancer, colorectal cancer, prostate cancer, pancreatic cancer, melanoma, breast cancer, neuroblastoma, lung cancer, ovarian cancer, bone cancer (e.g., osteosarcoma, chondrosarcoma, Ewing sarcoma), bladder cancer, cervical cancer, liver cancer, kidney cancer, skin cancer, testicular cancer, adrenal cancer, adenoid cystic carcinoma, anal cancer, brain cancer, ductal carcinoma, endometrial cancer, esophageal cancer, gastric cancer, oral cancer, thyroid cancer, retinoblastoma, parathyroid cancer, pituitary cancer, bile duct cancer, or uterine cancer. In some embodiments, the cancer is selected from the group consisting of lymphoma, sarcoma, bladder cancer, bone cancer, brain tumor, cervical cancer, colon cancer, esophageal cancer, gastric cancer, head and neck cancer, kidney cancer, myeloma, thyroid cancer, leukemia, prostate cancer, breast cancer (e.g. triple negative, ER positive, ER negative, chemotherapy resistant, Herceptin resistant, HER2 positive, doxorubicin resistant, tamoxifen resistant, ductal carcinoma, lobular carcinoma, primary, metastatic), ovarian cancer, pancreatic cancer, liver cancer (e.g. hepatocellular carcinoma), lung cancer (e.g. non-small cell lung carcinoma, squamous cell lung carcinoma, adenocarcinoma, large cell lung carcinoma, small cell lung carcinoma, carcinoid, sarcoma), glioblastoma multiforme, glioma, melanoma, prostate cancer, castration-resistant prostate cancer, breast cancer, triple negative breast cancer, glioblastoma, ovarian cancer, lung cancer, squamous cell carcinoma (e.g., head, neck, or esophagus), colorectal cancer, leukemia, acute myeloid leukemia, lymphoma, B cell lymphoma, or multiple myeloma. Additional examples include, cancer of the thyroid, endocrine system, brain, breast, cervix, colon, head & neck, esophagus, liver, kidney, lung, non-small cell lung, melanoma, mesothelioma, ovary, sarcoma, stomach, uterus or Medulloblastoma, Hodgkin's Disease, Non-Hodgkin's Lymphoma, multiple myeloma, neuroblastoma, glioma, glioblastoma multiforme, ovarian cancer, rhabdomyosarcoma, primary thrombocytosis, primary macroglobulinemia, primary brain tumors, cancer, malignant pancreatic insulanoma, malignant carcinoid, urinary bladder cancer, premalignant skin lesions, testicular cancer, lymphomas, thyroid cancer, neuroblastoma, esophageal cancer, genitourinary tract cancer, malignant hypercalcemia, endometrial cancer, adrenal cortical cancer, neoplasms of the endocrine or exocrine pancreas, medullary thyroid cancer, medullary thyroid carcinoma, melanoma, colorectal cancer, papillary thyroid cancer, hepatocellular carcinoma, Paget's Disease of the Nipple, Phyllodes Tumors, Lobular Carcinoma, Ductal Carcinoma, cancer of the pancreatic stellate cells, cancer of the hepatic stellate cells, or prostate cancer.

Another embodiment comprises a method of treating or preventing an inflammatory or autoimmune disease in a subject, the method comprising administering to the subject an effective amount of a disclosed masked cytokine composition, wherein the inflammatory or autoimmune disease is selected from the group consisting of atherosclerosis, obesity, inflammatory bowel disease (IBD), rheumatoid arthritis, allergic encephalitis, psoriasis, atopic skin disease, osteoporosis, peritonitis, hepatitis, lupus, celiac disease, Sjogren's syndrome, polymyalgia rheumatica, multiple sclerosis (MS), ankylosing spondylitis, type 1 diabetes mellitus, alopecia areata, vasculitis, and temporal arteritis, graft versus host disease (GVHD), asthma, COPD, a paraneoplastic autoimmune disease, cartilage inflammation, juvenile arthritis, juvenile rheumatoid arthritis, pauciarticular juvenile rheumatoid arthritis, polyarticular juvenile rheumatoid arthritis, systemic onset juvenile rheumatoid arthritis, juvenile ankylosing spondylitis, juvenile enteropathic arthritis, juvenile reactive arthritis, juvenile Reiter's Syndrome, SEA Syndrome (Seronegativity, Enthesopathy, Arthropathy Syndrome), juvenile dermatomyositis, juvenile psoriatic arthritis, juvenile Scleroderma, juvenile systemic lupus erythematosus, juvenile vasculitis, pauciarticular rheumatoid arthritis, systemic onset rheumatoid arthritis, enteropathic arthritis, reactive arthritis, Reiter's Syndrome, dermatomyositis, psoriatic arthritis, Scleroderma, vasculitis, myolitis, polymyolitis, dermatomyolitis, polyarteritis nodossa, Wegener's granulomatosis, arteritis, ploymyalgia rheumatica, sarcoidosis, Sclerosis, primary biliary Sclerosis, Sclerosing cholangitis, psoriasis, plaque psoriasis, guttate psoriasis, inverse psoriasis, pustular psoriasis, erythrodermic psoriasis, dermatitis, atopic dermatitis, atherosclerosis, Still's disease, Systemic Lupus Erythematosus (SLE), myasthenia gravis, Crohn's disease, ulcerative colitis, celiac disease, rhinosinusitis, rhinosinusitis with polyps, eosinophilic esophogitis, eosinophilic bronchitis, Guillain-Barre disease, thyroiditis (e.g., Graves' disease), Addison's disease, Raynaud's phenomenon, autoimmune hepatitis, transplantation rejection, kidney damage, hepatitis C-induced vasculitis, or spontaneous loss of pregnancy.

BRIEF DESCRIPTION OF THE DRAWINGS

FIG. 1A shows the structure of an exemplary embodiment of a masked cytokine as a monomer. FIG. 1B shows the structure of an exemplary embodiment of a masked cytokine as a homodimer formed by disulfide bonds.

FIG. 2A and FIG. 2B show the structure of exemplary embodiments of a masked cytokine that includes a first masking moiety ("Mask 1"), a cytokine or functional fragment thereof ("cytokine"), a second masking moiety ("Mask 2"), a half-life extension domain, a first linker that includes a first cleavable peptide ("1CP"), a first N-terminal spacer domain ("1NSD"), and a first C-terminal spacer domain ("1CSD"), and a second linker that includes a second cleavable peptide ("2CP"), a second N-terminal spacer domain ("2NSD"), and a second C-terminal spacer domain ("2CSD"). These exemplary embodiments also include a third linker that includes a third cleavable peptide ("3CP"), a third N-terminal spacer domain ("3NSD"), and a third C-terminal spacer domain ("3CSD"). FIG. 2A shows the structure of an exemplary embodiment of a masked cytokine as a monomer. FIG. 2B shows the structure of an exemplary embodiment of a masked cytokine as a homodimer formed by disulfide bonds.

FIG. 3A shows the structure of an exemplary embodiment of a masked cytokine that includes a masking moiety, a cytokine or functional fragment thereof ("cytokine"), a first half-life extension domain, and a second half-life extension domain. The exemplary embodiment shown in FIG. 3A also includes a first linker that includes a first cleavable peptide ("1CP"), a first N-terminal spacer domain ("1NSD"), and a first C-terminal spacer domain ("1CSD"), and a second linker that includes a second cleavable peptide ("2CP"), a second N-terminal spacer domain ("2NSD"), and a second C-terminal spacer domain ("2CSD"). The exemplary first and second half-life extension domains include "knobs into holes" modifications that promote the association of the first half-life extension domain with the second half-life extension domain, as shown by the "hole" in the first half-life extension domain and the "knob" in the second half-life extension domain. The first half-life extension domain and the second half-life extension domain are also shown as associating, at least in part, due to the formation of disulfide bonds. It is to be understood that although the "hole" is depicted as part of the first half-life extension domain (linked to the masking moiety) and the "knob" is depicted as part of the second half-life extension domain (linked to the cytokine), the "hole" and the "knob" can alternatively be included in the second half-life extension domain and the first half-life extension domain, respectively, so that the "hole" is a part of the second half-life extension domain (linked to the cytokine) and the "knob" is part of the first half-life extension domain (linked to masking moiety). FIG. 3B shows the structure of an exemplary embodiment of a masked cytokine that includes a masking moiety, a cytokine or functional fragment thereof ("cytokine"), a first half-life extension domain, a second half-life extension domain, and a third linker that includes a third N-terminal spacer domain ("3NSD") and a third C-terminal spacer domain ("3CSD"). The third linker links the first half-life extension domain to the second half-life extension domain. The exemplary embodiment shown in FIG. 3B also includes a first linker that includes a first cleavable peptide ("1CP"), a first N-terminal spacer domain ("1NSD"), and a first C-terminal spacer domain ("1CSD"), and a second linker that includes a second cleavable peptide ("2CP"), a second N-terminal spacer domain ("2NSD"), and a second C-terminal spacer domain ("2CSD").

FIGS. 7A-7E shows exemplary embodiments of masked cytokines prior to (left) and after (right) cleavage by a protease, such as at the tumor microenvironment. FIGS. 7A-7D show exemplary embodiments of a masked IL-2 cytokine, and FIG. 7E shows an exemplary embodiment of a masked IL-15 cytokine. Cleavage by a protease releases a masking moiety (e.g., IL-2Rβ, as shown in FIGS. 7A, 7B, and 7D), or releases an IL-2 (FIG. 7C), or releases IL-15 (FIG. 7E).

FIG. 9A shows the interaction between AK215 and CD25-Fc, FIG. 9B shows the interaction between AK216 and CD25-Fc, and FIG. 9C shows the interaction between a recombinant human IL2 (rhIL2) control and CD25-Fc. FIG. 9D provides a table summarizing the data obtained for the association constant (ka), dissociation constant (kd), equilibrium dissociation constant (KD), as well as the Chi$^2$ value and U-value for each interaction.

FIGS. 10A-10D shows results from SPR analysis that tested the binding of exemplary masked IL-2 polypeptide constructs (AK216 and AK218), or a rhIL2 control, to CD122-Fc. FIG. 10A shows the interaction between AK216 and CD122-Fc, FIG. 10B shows the interaction between AK218 and CD122-Fc, and FIG. 10C shows the interaction between a recombinant human IL2 (rhIL2) control and CD122-Fc. FIG. 10D provides a table summarizing the data obtained for the association constant (ka), dissociation constant (kd), equilibrium dissociation constant (KD), as well as the Chi$^2$ value and U-value for each interaction.

FIGS. 13A-13C shows STAT5 activation (%) in PBMCs treated with the construct AK081 or AK032. The AK081 construct with and without prior exposure to MMP10 was tested. An isotype control as well as a no IL-2 negative control was also tested. The levels of STAT5 activation (%) are shown for NK cells (FIG. 13A), CD8+ T cells (FIG. 13C), and CD4+ T cells (FIG. 13B).

FIG. 14D provides EC50 (pM) and fold-change data for the AK081, AK111 constructs, as well as the rhIL-2 control.

FIG. 15D provides EC50 (pM) and fold-change data for the AK167 and AK168 constructs, as well as the rhIL-2 control.

FIGS. 17A-17C shows STAT5 activation (%) in PBMCs treated with the construct AK109 or AK110, or an isotype control or an IL-2-Fc control, that were (+MMP10) or were not previously exposed to the MMP10 protease. The key as shown in FIG. 17B also applies to FIG. 17A. STAT5 activation (%) is shown for NK cells (FIG. 17A), CD8 cells (FIG. 17B), and CD4 cells (FIG. 17C).

FIG. 18D provides EC50 data for each of the tested constructs as well as the rhIL-2 control.

FIG. 19D provides EC50 data for each of the tested constructs as well as the rhIL-2 control.

FIGS. 20A-20C shows STAT5 activation (%) in PBMCs treated with the construct AK081, AK189, AK190, or AK210, or an anti-RSV control. The key as shown in FIG. 20A also applies to FIGS. 20B and 20C. STAT5 activation (%) is shown for regulatory T cells (FIG. 20A), CD4 helper T cells (FIG. 20B), and CD8 cells (FIG. 20C).

FIG. 22A shows results from a reporter bioassay using a HEK-Blue IL2 reporter cell line, and FIG. 22B shows results from a reporter bioassay using an IL-15 bioassay with a mouse CTLL2 cell line.

FIG. 23A provides a simplistic depiction of the structure of each of the constructs tested. FIG. 23B shows Fc levels in plasma (μg/mL) by detecting human IgG, FIG. 23C shows Fc-CD122 levels in plasma (μg/mL) by detecting human CD122, and FIG. 23D shows Fc-IL2 levels in plasma (μg/mL) by detecting human IL-2. Prior to the detection step, an anti-human IG was used as the capture antibody.

FIGS. 24A-24D show results from pharmacokinetic studies carried out in tumor-bearing mice using the construct AK167, AK191 AK197, AK203, AK209, or AK211, or an anti-RSV control. FIG. 24A provides a simplistic depiction of the structure of each of the constructs tested. FIG. 24B shows Fc levels in plasma (μg/mL) by detecting human IgG, FIG. 24C shows Fc-IL2 levels in plasma (μg/mL) by detecting human IL-2, and FIG. 24D shows Fc-CD122 levels in plasma (μg/mL) by detecting human CD122. Prior to the detection step, an anti-human IG was used as the capture antibody.

FIGS. 26A-26L shows results from studies testing the in vivo responses of CD4, CD8, NK, and Treg percentages in spleen, blood, and tumor, using the AK167, AK168, AK191, AK197, AK203, AK209, or AK211 construct, or an anti-RSV IgG control. For spleen tissue, % CD8 cells of CD3 cells (FIG. 26A), % CD4 of CD3 cells (FIG. 26B), % NK cells of CD3– cells (FIG. 26C), % FoxP3 of CD4 cells (FIG. 26D) is shown. For blood, % CD8 cells of CD3 cells (FIG. 26E), % CD4 of CD3 cells (FIG. 26F), % NK cells of CD3– cells (FIG. 26G), % FoxP3 of CD4 cells (FIG. 26H) is shown. For tumor tissue, % CD8 cells of CD3 cells (FIG. 26I), % CD4 of CD3 cells (FIG. 26J), % NK cells of CD3– cells (FIG. 26K), % FoxP3 of CD4 cells (FIG. 26L) is shown.

FIGS. 28A-28I show results from in vivo T cell activation in spleen, blood, and tumor, using the AK235, AK191, AK192, AK193, AK210, AK189, AK190, or AK211 construct. T cell activation was measured as the mean fluorescence intensity (MFI) of CD25 in CD8+ T cells (FIG. 28A; FIG. 28D; FIG. 28G), CD4+ T cells (FIG. 28B; FIG. 28E; FIG. 28H), or Foxp3+ cells (FIG. 28C; FIG. 28F; FIG. 28I) in the spleen, blood, and tumor. Statistical analysis was performed using One-way ANOVA as compared to the non-cleavable AK211 construct.

FIGS. 30A-30D shows results from an in vivo study that assessed vascular leakage using the exemplary masked IL-2 polypeptide construct AK111 or AK168, or the non-masked IL-2 polypeptide construct AK081 or AK167, or an anti-RSV control. FIG. 30A shows the percentage (%) of body weight loss, and FIGS. 30B, 30C, and 30D shows the weight in grams of the liver, lung, and spleen, respectively, for each.

FIG. 33A shows data on tumor volume over the course of treatment, and FIG. 33B shows data on the percentage (%) change in body weight over the course of the treatment.

DETAILED DESCRIPTION

Figure 1A:
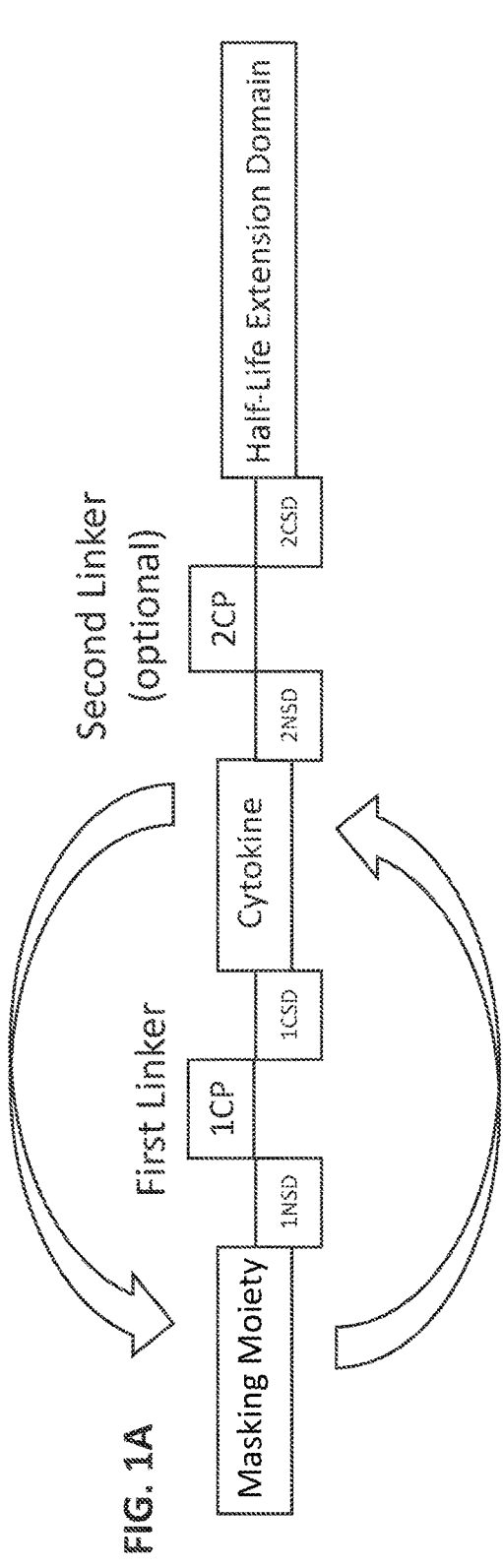
FIG. 1A and FIG. 1B show the structure of exemplary embodiments of a masked cytokine that includes a masking moiety, a cytokine or functional fragment thereof ("cytokine"), a half-life extension domain, and a first linker that includes a first cleavable peptide ("1CP"), a first N-terminal spacer domain ("1NSD"), and a first C-terminal spacer domain ("1CSD"). These exemplary embodiments also include a second linker that includes a second cleavable peptide ("2CP"), a second N-terminal spacer domain ("2NSD"), and a second C-terminal spacer domain ("2CSD"). As shown by the arrows, while the exemplary embodiments shows the masking moiety linked to the first linker, and the cytokine or functional fragment thereof is linked to the first linker and the second linker, the masking moiety and the cytokine or functional fragment thereof can be interchanged such that the cytokine or functional fragment thereof is linked to the first linker, and the masking moiety is linked to the first linker and the second linker.
Figure 1B:
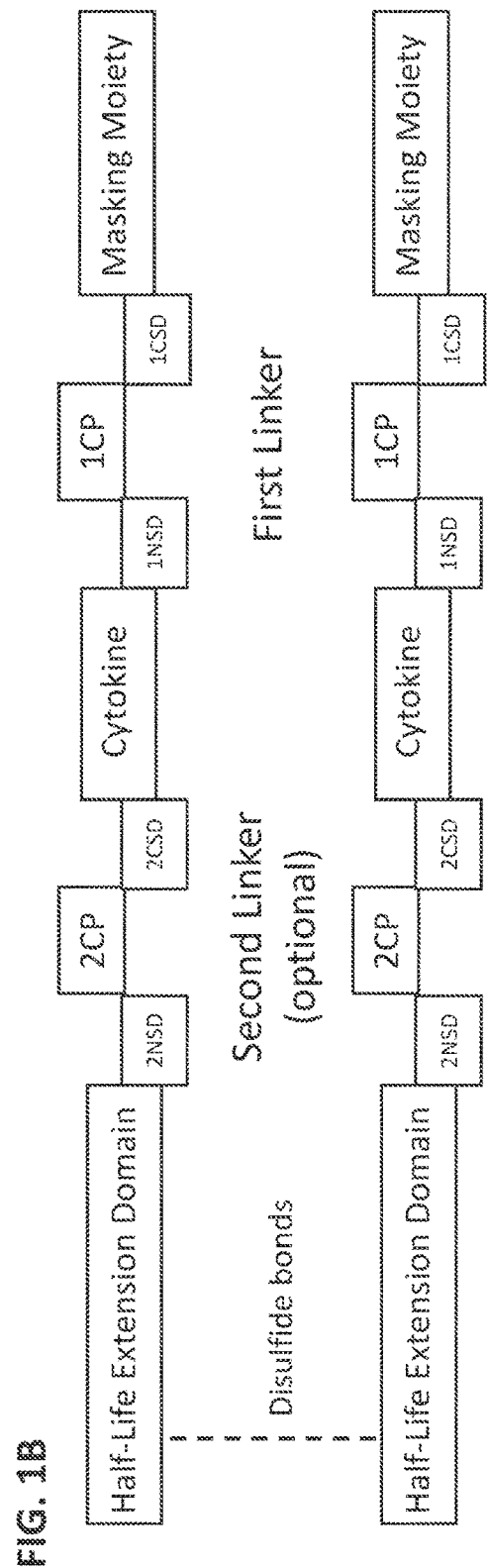
Figure 4:
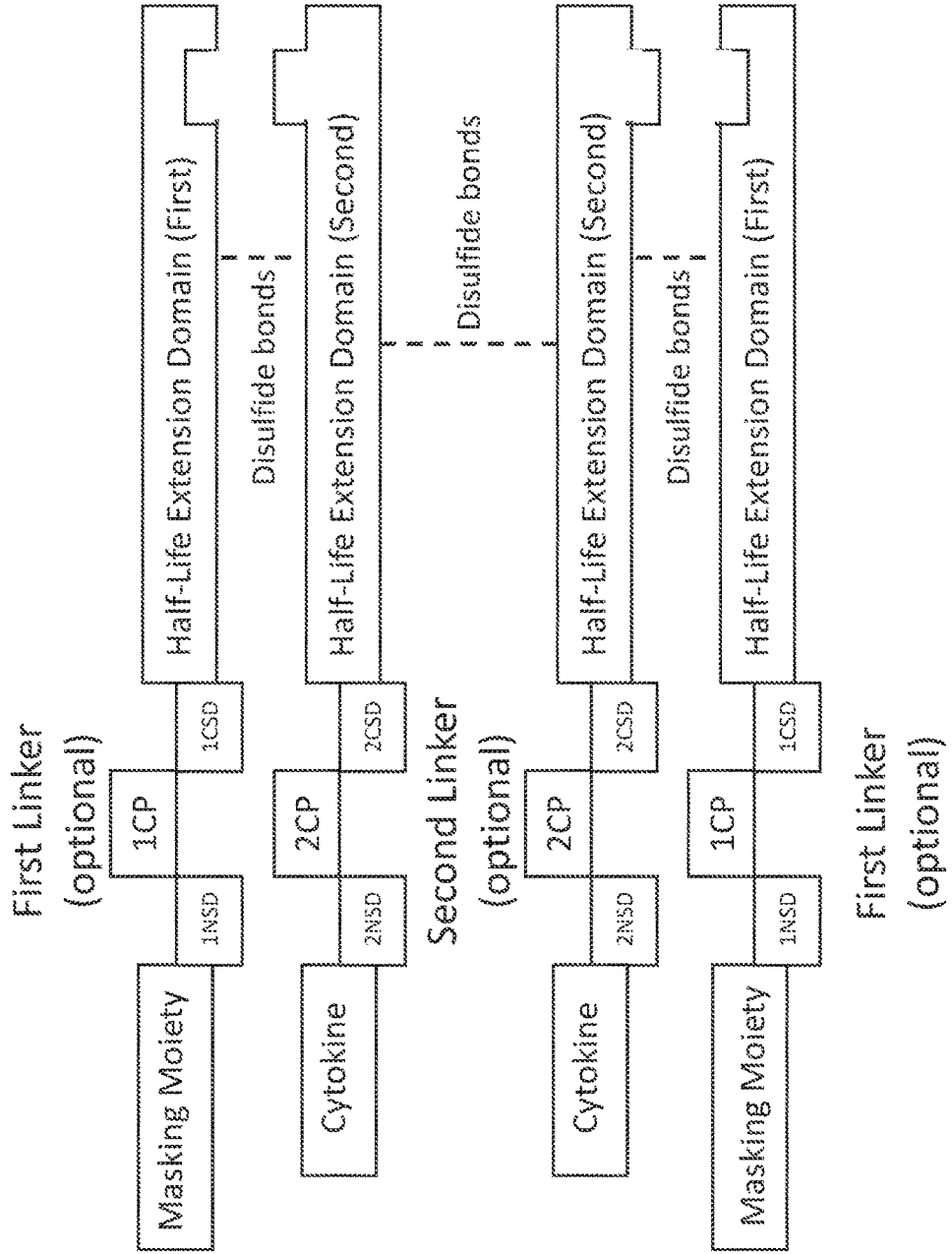
FIG. 4 shows a dimer of the exemplary masked cytokine shown in FIG. 3A formed by disulfide bonds.
Figure 5A:
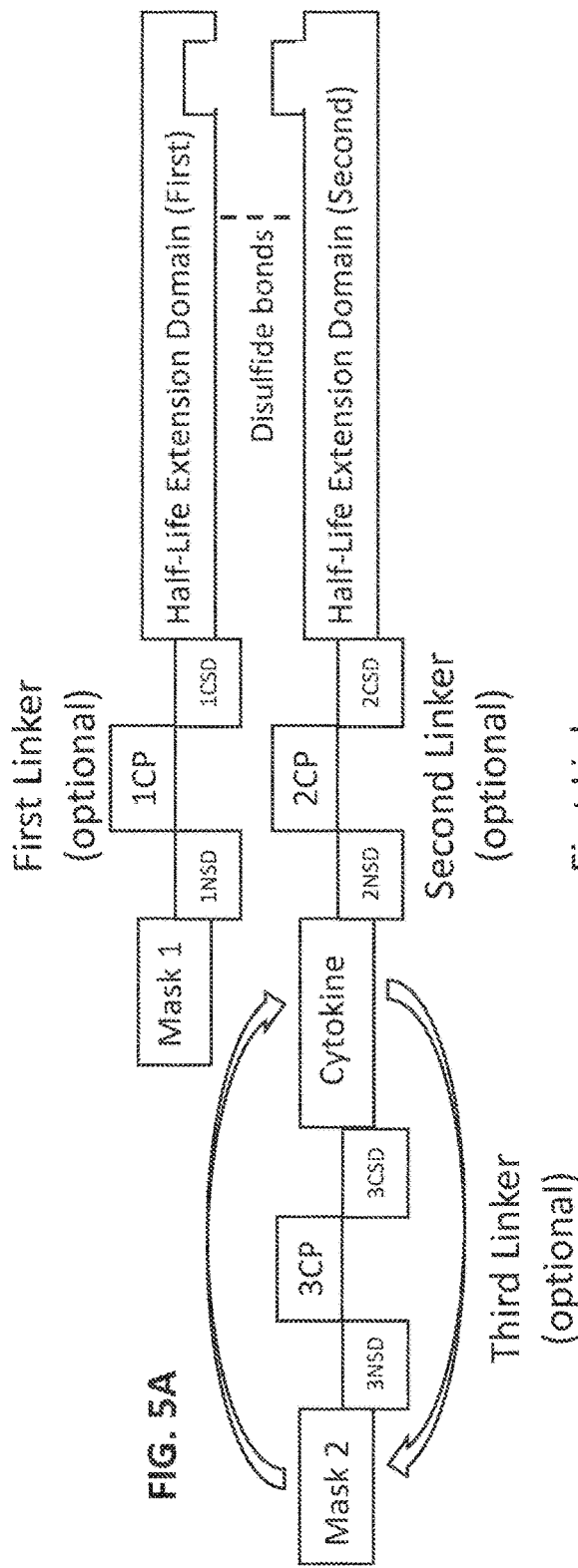
FIG. 5A shows the structure of an exemplary embodiment of a masked cytokine that includes a first masking moiety ("Mask 1"), a first half-life extension domain, a second masking moiety ("Mask 2"), a cytokine or functional fragment thereof ("cytokine"), and a second half-life extension domain. The exemplary embodiment shown in FIG. 5A also includes a first linker that includes a first cleavable peptide ("1CP"), a first N-terminal spacer domain ("1NSD"), and a first C-terminal spacer domain ("1CSD"), a second linker that includes a second cleavable peptide ("2CP"), a second N-terminal spacer domain ("2NSD"), and a second C-terminal spacer domain ("2CSD"), and a third linker that includes a third cleavable peptide ("3CP"), a third N-terminal spacer domain ("3NSD"), and a third C-terminal spacer domain ("3CSD"). It is to be understood that although the "hole" is depicted as part of the first half-life extension domain (linked to the masking moiety) and the "knob" is depicted as part of the second half-life extension domain (linked to the cytokine), the "hole" and the "knob" can alternatively be included in the second half-life extension domain and the first half-life extension domain, respectively, so that the "hole" is a part of the second half-life extension domain (linked to the cytokine) and the "knob" is part of the first half-life extension domain (linked to masking moiety).
Figure 5B:
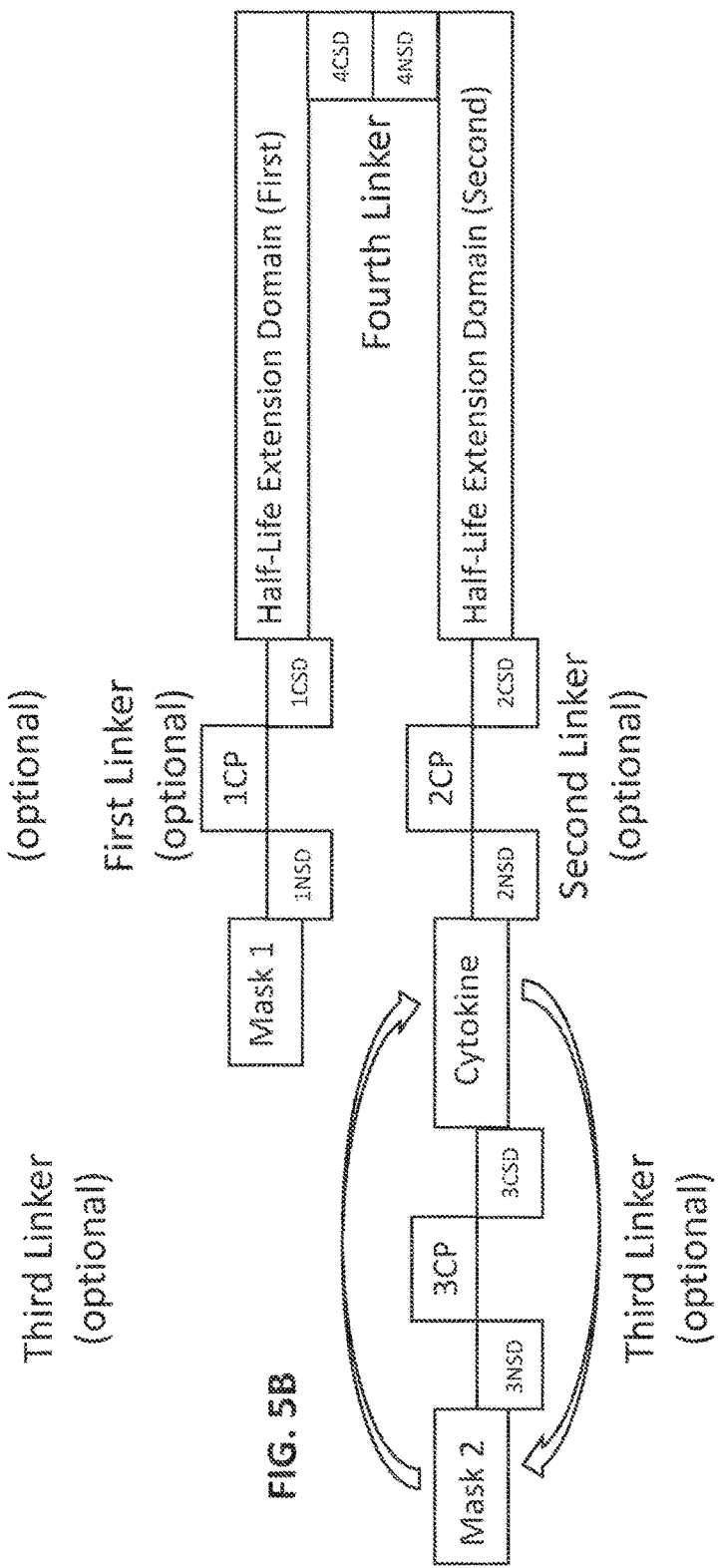
FIG. 5B shows the structure of an exemplary embodiment of a masked cytokine that includes a first masking moiety ("Mask 1"), a first half-life extension domain, a second masking moiety ("Mask 2"), a cytokine or functional fragment thereof ("cytokine"), a second half-life extension domain, and a fourth linker that includes a fourth N-terminal spacer domain ("4NSD") and a fourth C-terminal spacer domain ("4CSD"). The fourth linker links the first half-life extension domain to the second half-life extension domain. The exemplary embodiment shown in FIG. 5B also includes a first linker that includes a first cleavable peptide ("1CP"), a first N-terminal spacer domain ("1NSD"), and a first C-terminal spacer domain ("1CSD"), a second linker that includes a second cleavable peptide ("2CP"), a second N-terminal spacer domain ("2NSD"), and a second C-terminal spacer domain ("2CSD"), and a third linker that includes a third cleavable peptide ("3CP"), a third N-terminal spacer domain ("3NSD"), and a third C-terminal spacer domain ("3CSD"). As shown by the arrows in FIGS. 5A and 5B, while the exemplary embodiment shows the second masking moiety linked to the third linker, and the cytokine or functional fragment thereof is linked to the third linker and the second linker, the first masking moiety and the cytokine or functional fragment thereof can be interchanged such that the cytokine or functional fragment thereof is linked to the third linker, and the first masking moiety is linked to the third linker and the second linker.
Figure 6:
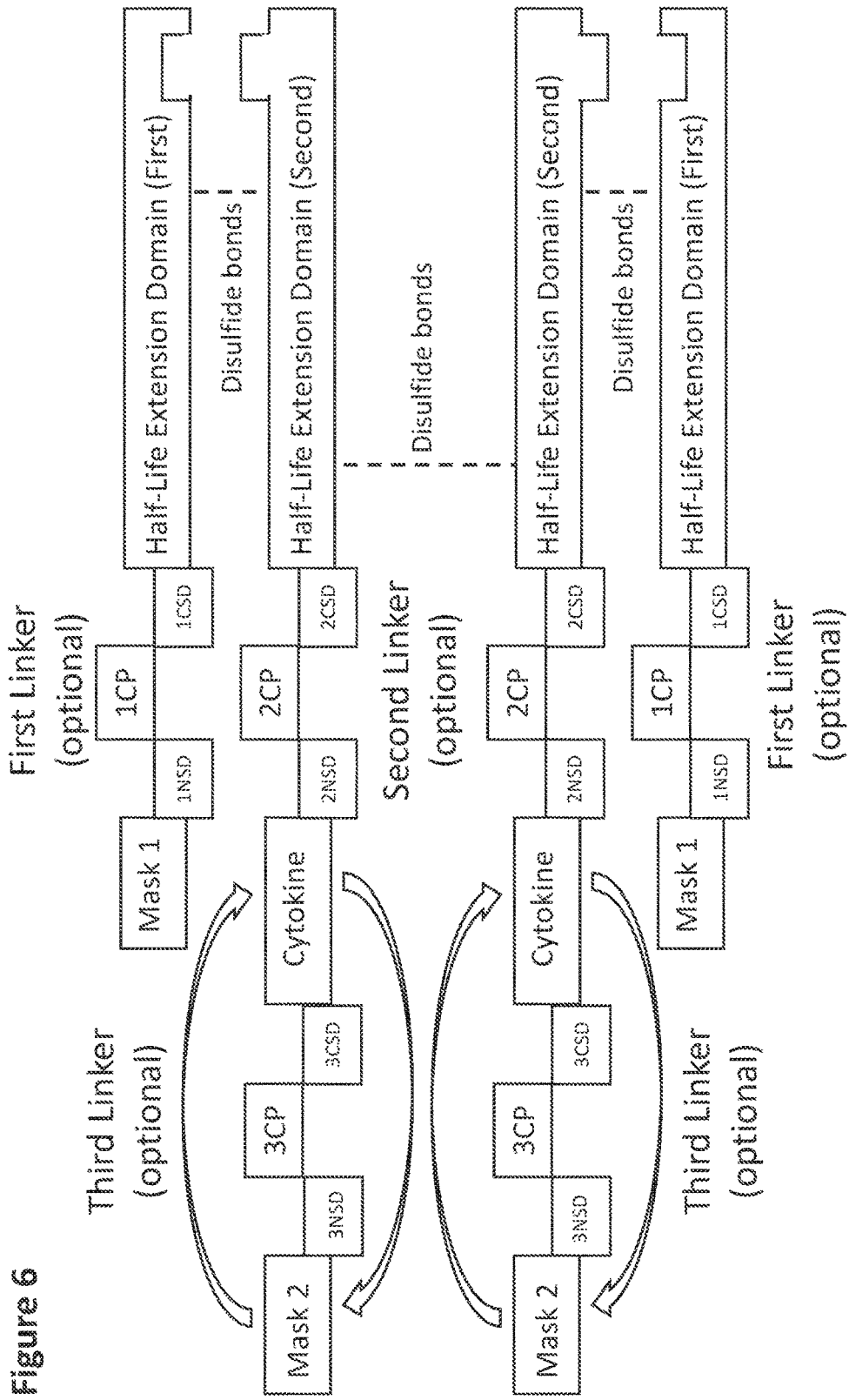
FIG. 6 shows a dimer of the exemplary masked cytokine shown in FIG. 5A formed by disulfide bonds.
Figure 7E:
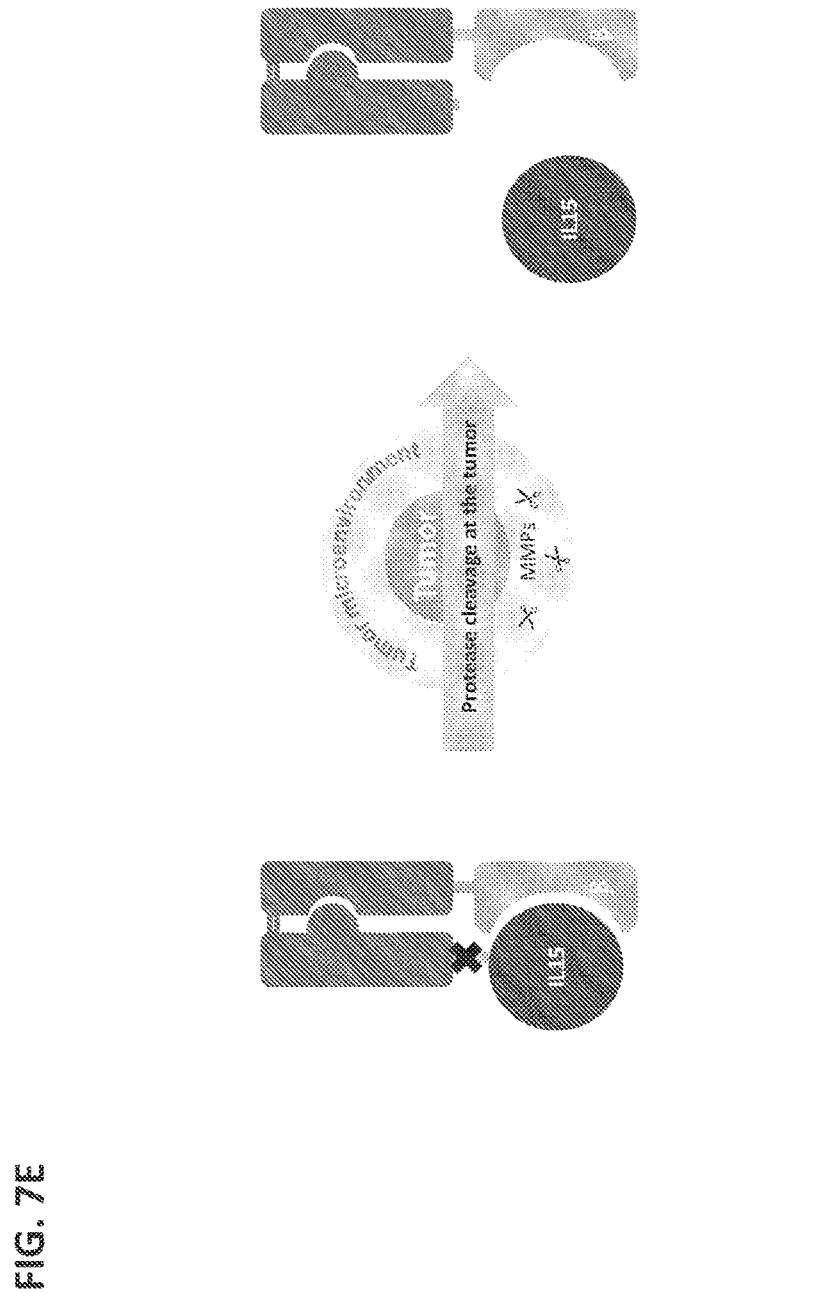

Provided herein are cytokines or functional fragments thereof that, in some embodiments, are engineered to be masked by a masking moiety at one or more receptor binding site(s) of the cytokine or functional fragment thereof. In some embodiments, the cytokines are engineered to be activatable by a protease at a target site, such as in a tumor microenvironment, by including a proteolytically cleavable linker. In some embodiments, the proteolytically cleavable linker links the cytokine to the masking moiety, links the cytokine to a half-life extension domain, and/or links the masking moiety to a half-life extension domain. The masking moiety blocks, occludes, inhibits (e.g., decreases) or otherwise prevents (e.g., masks) the activity or binding of the cytokine to its cognate receptor or protein. Upon proteolytic cleavage of the cleavable linker at the target site, the cytokine becomes activated, which renders it capable of binding to its cognate receptor or protein with increased affinity.

By using a masking moiety, the systemic side effects of an administered cytokine can be reduced by interfering with the binding capability of the cytokine. For instance, high-dose recombinant IL-2 (aldesleukin) has been approved by the FDA for the treatment of metastatic renal cell carcinoma and melanoma, but has been associated with severe cardiovascular, hepatic, pulmonary, gastrointestinal, neurologic, and hematological side effects. Preclinical studies showed, for instance, that IL-2-induced pulmonary edema is caused by the interaction between IL-2 and the IL-2Rα (CD25) subunit of the IL-2 receptor (IL-2R) on lung endothelial cells, and that this IL-2-mediated pulmonary adema could be abrogated by interfering with the ability of the IL-2 to bind IL-2Rα. See Krieg et al. (2010) PNAS, 107(26): 11906-11911. Thus, in some embodiments where the cytokine or functional fragment thereof is an IL-2 polypeptide, a masking moiety is employed that blocks, occludes, inhibits (e.g., decreases) or otherwise prevents (e.g., masks) the activity or binding of an IL-2 cytokine to IL-2Rα. To further reduce systemic effects of a masked IL-2 polypeptide, the masked IL-2 polypeptide can further include a masking moiety that blocks, occludes, inhibits (e.g., decreases) or otherwise prevents (e.g., masks) the activity or binding of the IL-2 cytokine to the IL-2Rβ and/or IL-2Rγ subunits of IL-2R. Similar strategies are likewise employed for other cytokines by interfering with their ability to bind certain proteins (e.g., a receptor subunit(s)) that are associated with causing detrimental systemic side effects. Moreover, by masking the cytokine using a linker that includes cleavable peptide, the binding capability that is interfered with by using the masking moiety can be restored by cleavage of the cleavable peptide at the tumor microenvironment. Thus, in some embodiments, the masked cytokines provided herein are engineered to precisely target pharmacological activity to the tumor microenvironment by exploiting one of the hallmarks of cancer, high local concentrations of active protease. This feature of the tumor microenvironment is used to transform a systemically inert molecule into a locally active cytokine. Activation of the cytokine at the tumor microenvironment significantly reduces systemic toxicities that can be associated with drugs that are administered to a subject in active form.

All publications, including patent documents, scientific articles and databases, referred to in this application are incorporated by reference in their entirety for all purposes to the same extent as if each individual publication were individually incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

I. MASKED CYTOKINES

Provided herein, in some embodiments, is a masked cytokine comprising (a) a masking moiety; and (b) a cytokine or functional fragment thereof, wherein the masking moiety is linked to the cytokine or functional fragment thereof via a first linker. In some embodiments, the masked cytokine further comprises a half-life extension domain that is linked to either the masking moiety or the cytokine or functional fragment thereof. In some embodiments, the half-life extension domain is linked to either the masking moiety or the IL-2 polypeptide or functional fragment thereof via a second linker.

In some embodiments, the masked cytokine comprises in an N to C-terminal direction: (a) the masking moiety; (b) the first linker; (c) the cytokine or functional fragment thereof; and (d) the half-life extension domain. In some embodiments, the masked cytokine comprises in a C to N-terminal direction: (a) the masking moiety; (b) the first linker; (c) the cytokine or functional fragment thereof; and (d) the half-life extension domain. In some embodiments, the masked cytokine comprises in an N to C-terminal direction: (a) the masking moiety; (b) the first linker; (c) the cytokine or functional fragment thereof; (d) the second linker and (e) the half-life extension domain. In some embodiments, the masked cytokine comprises in a C to N-terminal direction: (a) the masking moiety; (b) the first linker; (c) the cytokine or functional fragment thereof; (d) the second linker and (e) the half-life extension domain. In some embodiments, the masked cytokine comprises in an N to C-terminal direction: (a) the cytokine or functional fragment thereof; (b) the first linker; (c) the masking moiety; and (d) the half-life extension domain. In some embodiments, the masked cytokine comprises in a C to N-terminal direction: (a) the cytokine or functional fragment thereof; (b) the first linker; (c) the masking moiety; and (d) the half-life extension domain. In some embodiments, the masked cytokine comprises in an N to C-terminal direction: (a) the cytokine or functional fragment thereof; (b) the first linker; (c) the masking moiety; (d) the second linker; and (e) the half-life extension domain. In some embodiments, the masked cytokine comprises in a C to N-terminal direction: (a) the cytokine or functional fragment thereof; (b) the first linker; (c) the masking moiety; (d) the second linker; and (e) the half-life extension domain. In some embodiments, the masked cytokine comprises in an N to C-terminal direction: (a) the half-life extension domain; (b) the first linker; (c) the masking moiety; (d) the second linker; and (e) the cytokine or functional fragment thereof. In some embodiments, the masked cytokine comprises in an N to C-terminal direction: (a) the half-life extension domain; (b) the cytokine or functional fragment thereof; (c) the first linker; and (d) the masking moiety. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 585-597, 602, 610-614, 627-636, 642, and 643. In some embodiments, the masked cytokine comprises an amino acid sequence selected from the group consisting of SEQ ID NOs: 585-597, 602, 610-614, 627-636, 642, and 643. In some embodiments, the masked cytokine is any of the exemplary constructs described in Table 4 or Table 5, or is variant created by modifying any of the exemplary constructs described in Table 4 or Table 5, such as by incorporating one or more additional components to the structure of the construct in accordance with the teachings herein.

Also provided herein, in some embodiments, is a masked cytokine comprising (a) a first masking moiety; (b) a cytokine or functional fragment thereof, wherein the first masking moiety is linked to the cytokine or functional fragment thereof via a first linker; and (c) a second masking moiety, wherein the second masking moiety is linked to the cytokine or functional fragment thereof via a second linker. In some embodiments, the masked cytokine further comprises a half-life extension domain that is linked to either the first masking moiety or the second masking moiety. In some embodiments, the half-life extension domain is linked to either the first masking moiety or the second masking moiety via a third linker.

Also provided herein, in some embodiments, is a masked cytokine comprising (a) a first masking moiety, wherein the first masking moiety is linked to a first half-life extension domain; (b) a cytokine or functional fragment thereof, wherein the cytokine or functional fragment thereof is linked to a second half-life extension domain; and (c) a second masking moiety, wherein the second masking moiety is linked to the first masking moiety. In some embodiments, the first masking moiety is linked to the first half-life extension domain via a first linker. In some embodiments, the second masking moiety is linked to the first masking moiety via a second linker. In some embodiments, the cytokine or functional fragment thereof is linked to the second half-life extension domain via a third linker. In some embodiments, the first linker comprises a cleavable peptide. In some embodiments, the second linker comprises a cleavable peptide. In some embodiments, the third linker comprises a cleavable peptide.

In some embodiments, the masked cytokine comprises in an N to C-terminal direction: (a) the first masking moiety; (b) the first linker; (c) the cytokine or functional fragment thereof; (d) a second linker; (e) a second masking moiety; and (f) the half-life extension domain. In some embodiments, the masked cytokine comprises in a C to N-terminal direction: (a) the first masking moiety; (b) the first linker; (c) the cytokine or functional fragment thereof; (d) a second linker; (e) a second masking moiety; and (f) the half-life extension domain. In some embodiments, the masked cytokine comprises in an N to C-terminal direction: (a) the first masking moiety; (b) the first linker; (c) the cytokine or functional fragment thereof; (d) a second linker; (e) a second masking moiety; (f) the third linker; and (g) the half-life extension domain. In some embodiments, the masked cytokine comprises in a C to N-terminal direction: (a) the first masking moiety; (b) the first linker; (c) the cytokine or functional fragment thereof; (d) a second linker; (e) a second masking moiety; (f) the third linker; and (g) the half-life extension domain. In some embodiments, the masked cytokine comprises in an N to C-terminal direction: (a) the half-life extension domain; (b) a first linker; (c) the first masking moiety; (d) a second linker; (e) the cytokine or functional fragment thereof; (f) a third linker; and (g) the second masking moiety. In some embodiments, the masked cytokine comprises an amino acid sequence selected from the group consisting of SEQ ID NOs: 567 and 598-601. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 567 and 598-601. In some embodiments, the masked cytokine is any of the exemplary constructs described in Table 6 or Table 7, or is variant created by modifying any of the exemplary constructs described in Table 6 or Table 7, such as by incorporating one or more additional components to the structure of the construct in accordance with the teachings herein.

Also provided herein, in some embodiments, is a masked cytokine comprising (a) a first half-life extension domain and a second half-life extension domain; (b) a masking moiety; and (c) a cytokine or functional fragment thereof, wherein the masking moiety is linked to the first half-life extension domain, the cytokine or functional fragment thereof is linked to the second half-life extension domain, and the first half-life extension domain and the second half-life extension domain contain modifications promoting the association of the first and the second half-life extension domain. In some embodiments, the masking moiety is linked to the first half-life extension domain via a first linker, and/or the cytokine or functional fragment thereof is linked to the second half-life extension domain via a second linker. In some embodiments, the first half-life extension domain is linked to the second half-life extension domain, optionally by a third linker. In some embodiments, the masked cytokine comprises (a) a first half-life extension domain comprising the amino acid sequence of SEQ ID NO: 155 and a second half-life extension domain comprising the amino acid sequence of SEQ ID NO: 156; (b) a masking moiety comprising the amino acid sequence of SEQ ID NO: 261; and (c) a cytokine or functional fragment thereof comprising the amino acid sequence of SEQ ID NO: 3, wherein the masking moiety is linked to the first half-life extension domain via a first linker comprising the amino acid sequence of SEQ ID NO: 28, the cytokine or functional fragment thereof is linked to the second half-life extension domain via a second linker comprising the amino acid sequence of SEQ ID NO: 811, the first half-life extension domain and the second half-life extension domain contain modifications promoting the association of the first and the second half-life extension domain, and the masked cytokine comprises the amino acid sequences of SEQ ID NOs: 266 and 267. In some embodiments, the masked cytokine comprises (a) a first half-life extension domain comprising the amino acid sequence of SEQ ID NO: 155 and a second half-life extension domain comprising the amino acid sequence of SEQ ID NO: 156; (b) a masking moiety comprising the amino acid sequence of SEQ ID NO: 261; and (c) a cytokine or functional fragment thereof comprising the amino acid sequence of SEQ ID NO: 260, wherein the masking moiety is linked to the first half-life extension domain via a first linker comprising the amino acid sequence of SEQ ID NO: 28, the cytokine or functional fragment thereof is linked to the second half-life extension domain via a second linker comprising the amino acid sequence of SEQ ID NO: 262, the first half-life extension domain and the second half-life extension domain contain modifications promoting the association of the first and the second half-life extension domain, and the masked cytokine comprises the amino acid sequences of SEQ ID NOs: 266 and 267. In some embodiments, the masked cytokine comprises the amino acid sequence of SEQ ID NO: 266. In some embodiments, the masked cytokine comprises the amino acid sequence of SEQ ID NO: 267. In some embodiments, the masked cytokine comprises the amino acid sequences of SEQ ID NOs: 266 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 266. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 266, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises (a) a first half-life extension domain comprising the amino acid sequence of SEQ ID NO: 155 and a second half-life extension domain comprising the amino acid sequence of SEQ ID NO: 156; (b) a masking moiety comprising the amino acid sequence of SEQ ID NO: 261; and (c) a cytokine or functional fragment thereof comprising the amino acid sequence of SEQ ID NO: 3, wherein the masking moiety is linked to the first half-life extension domain via a first linker comprising the amino acid sequence of SEQ ID NO: 28, the cytokine or functional fragment thereof is linked to the second half-life extension domain via a second linker comprising the amino acid sequence of SEQ ID NO: 807, the first half-life extension domain and the second half-life extension domain contain modifications promoting the association of the first and the second half-life extension domain, and the masked cytokine comprises the amino acid sequences of SEQ ID NOs: 679 and 267. In some embodiments, the masked cytokine comprises (a) a first half-life extension domain comprising the amino acid sequence of SEQ ID NO: 156 and a second half-life extension domain comprising the amino acid sequence of SEQ ID NO: 155; (b) a masking moiety comprising the amino acid sequence of SEQ ID NO: 261; and (c) a cytokine or functional fragment thereof comprising the amino acid sequence of SEQ ID NO: 3, wherein the masking moiety is linked to the first half-life extension domain via a first linker comprising the amino acid sequence of SEQ ID NO: 28, the cytokine or functional fragment thereof is linked to the second half-life extension domain via a second linker comprising the amino acid sequence of SEQ ID NO: 807, the first half-life extension domain and the second half-life extension domain contain modifications promoting the association of the first and the second half-life extension domain, and the masked cytokine comprises the amino acid sequences of SEQ ID NOs: 679 and 267.

In some embodiments, the masked cytokine comprises (a) a first half-life extension domain comprising the amino acid sequence of SEQ ID NO: 155 and a second half-life extension domain comprising the amino acid sequence of SEQ ID NO: 156; (b) a masking moiety comprising the amino acid sequence of SEQ ID NO: 261; and (c) a cytokine or functional fragment thereof comprising the amino acid sequence of SEQ ID NO: 3, wherein the masking moiety is linked to the first half-life extension domain via a first linker, the cytokine or functional fragment thereof is linked to the second half-life extension domain via a second linker, the first half-life extension domain and the second half-life extension domain contain modifications promoting the association of the first and the second half-life extension domain, wherein the first linker and/or the second linker comprises a cleavable peptide. In some embodiments, the masked cytokine comprises (a) a first half-life extension domain comprising the amino acid sequence of SEQ ID NO: 156 and a second half-life extension domain comprising the amino acid sequence of SEQ ID NO: 155; (b) a masking moiety comprising the amino acid sequence of SEQ ID NO: 261; and (c) a cytokine or functional fragment thereof comprising the amino acid sequence of SEQ ID NO: 3, wherein the masking moiety is linked to the first half-life extension domain via a first linker, the cytokine or functional fragment thereof is linked to the second half-life extension domain via a second linker, the first half-life extension domain and the second half-life extension domain contain modifications promoting the association of the first and the second half-life extension domain, wherein the first linker and/or the second linker comprises a cleavable peptide.

In some embodiments, the masked cytokine comprises (a) a first half-life extension domain comprising the amino acid sequence of SEQ ID NO: 155 and a second half-life extension domain comprising the amino acid sequence of SEQ ID NO: 156; (b) a masking moiety comprising the amino acid sequence of SEQ ID NO: 261; and (c) a cytokine or functional fragment thereof comprising the amino acid sequence of SEQ ID NO: 1, wherein the masking moiety is linked to the first half-life extension domain via a first linker comprising the amino acid sequence of SEQ ID NO: 28, the cytokine or functional fragment thereof is linked to the second half-life extension domain via a second linker comprising the amino acid sequence of SEQ ID NO: 812, the first half-life extension domain and the second half-life extension domain contain modifications promoting the association of the first and the second half-life extension domain, and the masked cytokine comprises the amino acid sequences of SEQ ID NOs: 689 and 267. In some embodiments, the masked cytokine comprises (a) a first half-life extension domain comprising the amino acid sequence of SEQ ID NO: 156 and a second half-life extension domain comprising the amino acid sequence of SEQ ID NO: 155; (b) a masking moiety comprising the amino acid sequence of SEQ ID NO: 261; and (c) a cytokine or functional fragment thereof comprising the amino acid sequence of SEQ ID NO: 1, wherein the masking moiety is linked to the first half-life extension domain via a first linker comprising the amino acid sequence of SEQ ID NO: 28, the cytokine or functional fragment thereof is linked to the second half-life extension domain via a second linker comprising the amino acid sequence of SEQ ID NO: 812, the first half-life extension domain and the second half-life extension domain contain modifications promoting the association of the first and the second half-life extension domain, and the masked cytokine comprises the amino acid sequences of SEQ ID NOs: 689 and 267.

In some embodiments, the masked cytokine comprises (a) a first half-life extension domain comprising the amino acid sequence of SEQ ID NO: 155 and a second half-life extension domain comprising the amino acid sequence of SEQ ID NO: 156; (b) a masking moiety comprising the amino acid sequence of SEQ ID NO: 261; and (c) a cytokine or functional fragment thereof comprising the amino acid sequence of SEQ ID NO: 1, wherein the masking moiety is linked to the first half-life extension domain via a first linker, the cytokine or functional fragment thereof is linked to the second half-life extension domain via a second linker, the first half-life extension domain and the second half-life extension domain contain modifications promoting the association of the first and the second half-life extension domain, wherein the first linker and/or the second linker comprises a cleavable peptide. In some embodiments, the masked cytokine comprises (a) a first half-life extension domain comprising the amino acid sequence of SEQ ID NO: 156 and a second half-life extension domain comprising the amino acid sequence of SEQ ID NO: 155; (b) a masking moiety comprising the amino acid sequence of SEQ ID NO: 261; and (c) a cytokine or functional fragment thereof comprising the amino acid sequence of SEQ ID NO: 1, wherein the masking moiety is linked to the first half-life extension domain via a first linker, the cytokine or functional fragment thereof is linked to the second half-life extension domain via a second linker, the first half-life extension domain and the second half-life extension domain contain modifications promoting the association of the first and the second half-life extension domain, wherein the first linker and/or the second linker comprises a cleavable peptide.

In some embodiments, the masked cytokine comprises the amino acid sequences of SEQ ID NOs: 562 and 563. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 562, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 563.

In some embodiments, the masked cytokine comprises the amino acid sequences of SEQ ID NOs: 608 and 603. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 608, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 603.

In some embodiments, the masked cytokine comprises the amino acid sequences of SEQ ID NOs: 604 and 603. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 604, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 603.

In some embodiments, the masked cytokine comprises the amino acid sequences of SEQ ID NOs: 605 and 603. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 605, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 603.

In some embodiments, the masked cytokine comprises the amino acid sequences of SEQ ID NOs: 606 and 603. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 606, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 603.

In some embodiments, the masked cytokine comprises the amino acid sequences of SEQ ID NOs: 615 and 617. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 615, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 617.

In some embodiments, the masked cytokine comprises the amino acid sequences of SEQ ID NOs: 618 and 620. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 618, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 620.

In some embodiments, the masked cytokine comprises the amino acid sequences of SEQ ID NOs: 621 and 623. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 621, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 623.

In some embodiments, the masked cytokine comprises the amino acid sequences of SEQ ID NOs: 624 and 626. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 624, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 626.

In some embodiments, the masked cytokine comprises the amino acid sequences of SEQ ID NOs: 608 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 608, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 663 and 664. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 663, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 664.

In some embodiments, the masked cytokine comprises the amino acid sequences of SEQ ID NOs: 665 and 666. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 665, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 666.

In some embodiments, the masked cytokine comprises the amino acid sequences of SEQ ID NOs: 667 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 667, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 669 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 669, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 670 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 670, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 672 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 672, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 673 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 673, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 674 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 674, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 675 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 675, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 676 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 676, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 677 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 677, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 678 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 678, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 679 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 679, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 680 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 680, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 681 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 681, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 682 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 682, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 683 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 683, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 684 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 684, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 685 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 685, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 686 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 686, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 687 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 687, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 688 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 688, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 689 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 689, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 690 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 690, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 266 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 266, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 692 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 692, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 693 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 693, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 694 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 694, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 695 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 695, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 696 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 696, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 697 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 697, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 698 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 698, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 699 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 699, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 700 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 700, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 701 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 701, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 702 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 702, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 703 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 703, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 704 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 704, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 705 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 705, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 706 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 706, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 707 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 707, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 708 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 708, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 709 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 709, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 710 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 710, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 711 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 711, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 712 and 667. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 712, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 667.

In some embodiments, the masked cytokine comprises the amino acid sequences of SEQ ID NOs: 713 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 713, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 714 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 714, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 716 and 699. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 716, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 699.

In some embodiments, the masked cytokine comprises the amino acid sequences of SEQ ID NOs: 717 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 717, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 718 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 718, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 719 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 719, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 720 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 720, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 722 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 722, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 723 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 723, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 726 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 720, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 728 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 728, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 729 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 729, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 730 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 730, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 731 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 731, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 732 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 732, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 733 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 733, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 734 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 734, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 735 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 735, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 736 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 736, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 737 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 737, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 738 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 738, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 739 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 739, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 740 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 740, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 741 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 741, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 742 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 742, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 743 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 743, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 744 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 744, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 745 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 745, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 746 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 746, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 674 and 828. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 674, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 828.

In some embodiments, the masked cytokine comprises the amino acid sequences of SEQ ID NOs: 674 and 829. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 674, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 829.

In some embodiments, the masked cytokine comprises the amino acid sequences of SEQ ID NOs: 726 and 830. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 726, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 830.

In some embodiments, the masked cytokine comprises the amino acid sequences of SEQ ID NOs: 726 and 829. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 726, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 829.

In some embodiments, the masked cytokine comprises the amino acid sequences of SEQ ID NOs: 747 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 747, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 715 and 267. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 715, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 267.

In some embodiments, the masked cytokine comprises the amino acid sequences of SEQ ID NOs: 715 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 715, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 748 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 748, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 749 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 749, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 750 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 750, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 751 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 751, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 752 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 752, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 753 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 753, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 754 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 754, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 758 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 758, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 759 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 759, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 760 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 760, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine comprises the amino acid sequences of SEQ ID NOs: 761 and 671. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 761, and comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 671.

In some embodiments, the masked cytokine is an exemplary masked cytokine construct as described in any of Tables 8-11, or is a variant created by modifying any of the exemplary constructs described in Tables 8-11, such as by incorporating one or more additional components to the structure of the construct in accordance with the teachings herein.

Also provided herein, in some embodiments, is a masked cytokine comprising (a) a first half-life extension domain and a second half-life extension domain; (b) a first masking moiety and a second masking moiety; and (c) a cytokine or functional fragment thereof, wherein the first masking moiety is linked to the first half-life extension domain, the second masking moiety is linked to the cytokine or functional fragment thereof, either the second masking moiety or the cytokine or functional fragment thereof is linked to the second half-life extension domain, and the first half-life extension domain and the second half-life extension domain contain modifications promoting the association of the first and the second half-life extension domain. In some embodiments, the first masking moiety is linked to the first half-life extension domain via a first linker, and/or either the second masking moiety or the cytokine or functional fragment thereof is linked to the second half-life extension domain via a second linker. In some embodiments, the second masking moiety is linked to the cytokine or functional fragment thereof via a third linker. In some embodiments, the first half-life extension domain is linked to the second half-life extension domain, optionally by a fourth linker. In some embodiments, the masked cytokine comprises the amino acid sequences of SEQ ID NOs: 755 and 616. In some embodiments, the masked cytokine comprises the amino acid sequences of SEQ ID NOs: 756 and 616. In some embodiments, the masked cytokine comprises the amino acid sequences of SEQ ID NOs: 757 and 616. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 755, and an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 616. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 756, and an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 616. In some embodiments, the masked cytokine comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 757, and an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 616.

In some embodiments, the masked cytokine comprises an amino acid sequence selected from the group consisting of SEQ ID NOs: 265-267, 556-720, 722, 723, 726, 728-761, and 828-830. In some embodiments, the masked cytokine comprises two different amino acid sequences selected from the group consisting of SEQ ID NOs: 265-267, 556-720, 722, 723, 726, 728-761, and 828-830. In some embodiments, the masked cytokine comprises the amino acid sequences associated with any of the exemplary constructs as described in Tables 4-11.

Each component of the masked cytokines provided herein is discussed in greater detail below.

A. Cytokines

Provided herein is a cytokine or functional fragment thereof. The cytokine or functional fragment thereof can be any cytokine, any functional fragment of any cytokine, or any natural or non-natural variant of any cytokine. A cytokine is a small polypeptide that plays a role in cellular signaling, particularly in cells of the immune system. Examples of cytokines may include chemokines, interferons, interleukins, lymphokines, and tumor necrosis factors.

Cytokines can be classified in a variety of ways, such as based on their three-dimensional structure. Examples include the β-trefoil fold class, the short-chain four-helix bundle class, and the long-chain four-helix bundle class.

The β-trefoil fold class includes cytokines that are characterized by three βββ-loop-β units (12β strands total) that form a barrel structure with a hairpin cap for the barrel. Examples of cytokines in the β-trefoil fold class include IL-1α, IL-1β, IL-1 receptor antagonist (IL-1RA), IL-18, IL-33, IL-36α, IL-36β, IL-36γ, IL-36 receptor antagonist (IL-36RA), IL-37, and IL-38.

Short-chain and long-chain four-helix bundle classes are characterized by a monomeric helical bundle having four amphipathic helices oriented in a unique up-up-down-down topology. The short-chain four-helix bundle class is characterized by shorter helices, such as those 10-20 amino acid residues in length, while the long-chain four-helix bundle class is characterized by longer helices, such as those 20-30 amino acid residues in length. Examples of cytokines in the short-chain four-helix bundle class include IL-2, IL-3, IL-4, IL-5, IL-7, IL-9, IL-13, IL-15, IL-21, granulocyte-macrophage colony-stimulating factor (GM-CSF), and macrophage colony-stimulating factor (M-CSF). Examples of cytokine in the long-chain four-helix bundle class include IL-6, IL-11, IL-12, growth hormone (GH), erythropoietin (EPO), prolactin (PRL), leukemia inhibitory factor (LIF), oncostatin (OSM), and thrombopoietin (TPO).

In contrast to the short- and long-chain four-helix bundle classes, which are monomeric, some cytokines are homodimeric. Examples of dimeric cytokines include IL-10 and IFN-γ (gamma).

Some cytokines are classified as being heterodimeric. Examples of heterodimeric cytokines include IL-12 and IL-23.

Some cytokines, such as IL-15, also function by binding to, and being presented by, a membrane-bound cytokine receptor.

In some embodiments, the cytokine or functional fragment thereof is IL-2, or is a functional fragment or variant of IL-2. In some embodiments, the cytokine or functional fragment thereof is IL-15, or is a functional fragment or variant of IL-15. In some embodiments, the cytokine or functional fragment thereof is selected from the group consisting of IL-2, IL-10, IL-12, IL-15, IL-18, interferon (IFN)-α (alpha), IFN-β (beta), and IFN-γ (gamma). In some embodiments, the cytokine or functional fragment thereof is a functional fragment or variant of IL-2, IL-10, IL-12, IL-15, IL-18, IFN-α (alpha), IFN-β (beta), or IFN-γ (gamma).

In some embodiments, the cytokine or functional fragment thereof is selected from the group consisting of IL-1α, IL-1β, IL-1 receptor antagonist (IL-1RA), IL-18, IL-33, IL-36α, IL-36β, IL-36γ, IL-36 receptor antagonist (IL-36RA), IL-37, and IL-38.

In some embodiments, the cytokine or functional fragment thereof is selected from the group consisting of IL-2, IL-3, IL-4, IL-5, IL-7, IL-9, IL-13, IL-15, IL-21, granulocyte-macrophage colony-stimulating factor (GM-CSF), macrophage colony-stimulating factor (M-CSF), IL-6, IL-11, IL-12, growth hormone (GH), erythropoietin (EPO), prolactin (PRL), leukemia inhibitory factor (LIF), oncostatin (OSM), and thrombopoietin (TPO).

In some embodiments, the cytokine or functional fragment thereof is selected from the group consisting of CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CCL1e, CCL2, CCL3, CCL3L1, CCL4, CCL5, CCL6, CCL7, CCL8, CCL9/10, CCL11, CCL12, CCL13, CCL14, CCL15, CCL16, CCL17, CCL18, CCL19, CCL20, CCL21, CCL22, CCL23, CCL24, CCL25, CCL26, CCL27, CCL28, CX3CL1, XCL1, and XCL2. In some embodiments, the cytokine or functional fragment thereof is a functional fragment or variant of CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CCL1e, CCL2, CCL3, CCL3L1, CCL4, CCL5, CCL6, CCL7, CCL8, CCL9/10, CCL11, CCL12, CCL13, CCL14, CCL15, CCL16, CCL17, CCL18, CCL19, CCL20, CCL21, CCL22, CCL23, CCL24, CCL25, CCL26, CCL27, CCL28, CX3CL1, XCL1, or XCL2.

In some embodiments, the cytokine or functional fragment thereof is selected from the group consisting of IFN-α (alpha), IFN-β (beta), IFN-γ (gamma), IFN-ε (epsilon), IFN-κ (kappa), IFN-ω (omega), IFN-τ (tau), IFN-ζ (zeta), IFN-δ (delta), and IFN-λ (lambda). In some embodiments, the cytokine or functional fragment thereof is a functional fragment or variant of IFN-α (alpha), IFN-β (beta), IFN-γ (gamma), IFN-ε (epsilon), IFN-κ (kappa), IFN-ω (omega), IFN-τ (tau), IFN-ζ (zeta), IFN-δ (delta), or IFN-λ (lambda).

In some embodiments, the cytokine or functional fragment thereof is selected from the group consisting of IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28A, IL-28B, IL-29, IL-30, IL-31, IL-32, IL-33, IL-34, IL-35, IL-36, and IL-37. In some embodiments, the cytokine or functional fragment thereof is a functional fragment or variant of IL-1, IL-2, IL-3, IL-4, IL-5, IL-6, IL-7, IL-8, IL-9, IL-10, IL-11, IL-12, IL-13, IL-14, IL-15, IL-16, IL-17A, IL-17C, IL-17D, IL-17F, IL-17A/F, IL-18, IL-19, IL-20, IL-21, IL-22, IL-23, IL-24, IL-25, IL-26, IL-27, IL-28A, IL-28B, IL-29, IL-30, IL-31, IL-32, IL-33, IL-34, IL-35, IL-36, or IL-37.

In some embodiments, the cytokine or functional fragment thereof is selected from the group consisting of granulocyte-macrophage colony-stimulating factor (GM-CSF), macrophage colony-stimulating factor (M-CSF), tumor necrosis factor alpha (TNF-α), transforming growth factor beta (TGF-β), IFN-γ (gamma), IL-2, IL-3, IL-4, IL-5, IL-6, IL-7, IL-8, and IL-12. In some embodiments, the cytokine or functional fragment thereof is a functional fragment or variant of granulocyte-macrophage colony-stimulating factor (GM-CSF), macrophage colony-stimulating factor (M-CSF), tumor necrosis factor alpha (TNF-α), transforming growth factor beta (TGF-β), IFN-γ (gamma), IL-2, IL-3, IL-4, IL-5, IL-6, IL-7, IL-8, or IL-12.

In some embodiments, the cytokine or functional fragment thereof is selected from the group consisting of TNF-α (alpha), TNF-β (beta), TNF-γ (gamma), CD252, CD154, CD178, CD70, CD153, 4-1BB-L, TRAIL, RANKL, APO3L, CD256, CD257, CD258, TL1, AITRL, and EDA1. In some embodiments, the cytokine or functional fragment thereof is a functional fragment or variant of TNF-α (alpha), TNF-β (beta), TNF-γ (gamma), CD252, CD154, CD178, CD70, CD153, 4-1BB-L, TRAIL, RANKL, APO3L, CD256, CD257, CD258, TL1, AITRL, and EDA1.

The cytokine or functional fragment thereof comprises an amino-terminus and a carboxy-terminus. In some embodiments, a half-life extension domain is linked to the amino-terminus or the carboxy-terminus of the cytokine or functional fragment thereof. In some embodiments, a masking moiety is linked to the amino-terminus or the carboxy-terminus of the cytokine or functional fragment thereof. In some embodiments, a linker is linked to the amino-terminus or the carboxy-terminus of the cytokine or functional fragment thereof. In some embodiments, a cleavable peptide of a linker is linked to the amino-terminus or the carboxy-terminus of the cytokine or functional fragment thereof. In some embodiments, an N-terminal spacer domain or a C-terminal spacer domain of a linker is linked to the amino-terminus or the carboxy-terminus of the cytokine or functional fragment thereof.

Exemplary embodiments of the cytokine or functional fragment thereof in the form of IL-2 polypeptides or functional fragments thereof, and IL-15 polypeptides or functional fragments thereof, are provided below in detail.

1. IL-2 Polypeptides

In some embodiments, the cytokine or functional fragment thereof is an IL-2 polypeptide or functional fragment thereof. In eukaryotic cells, IL-2 is synthesized as a precursor polypeptide of 153 amino acids, which is then processed into mature IL-2 by the removal of amino acid residues 1-20. This results in a mature form of IL-2 consisting of 133 amino acids (amino acid residues 21-153) that is secreted in a mature, active form.

In some embodiments, the IL-2 polypeptide or functional fragment thereof is any naturally occurring interleukin-2 (IL-2) protein or modified variant thereof capable of binding to, or otherwise exhibiting affinity for, an interleukin-2 receptor (IL-2R) or component thereof (e.g., the IL-2Rα chain). In some embodiments, the IL-2 polypeptide or functional fragment thereof is a mature form of IL-2 that consists of amino acid residues 21-153 of SEQ ID NO: 159. In some embodiments, the IL-2 polypeptide or functional fragment thereof comprises the amino acid sequence of SEQ ID NO: 160. In some embodiments, the IL-2 polypeptide or functional fragment thereof comprises an amino acid sequence selected from the group consisting of SEQ ID NOs: 1-8 and 260. In some embodiments, the IL-2 polypeptide or functional fragment thereof comprises the amino acid sequence of SEQ ID NO: 260. In some embodiments, the IL-2 polypeptide or functional fragment thereof comprises an amino acid sequence selected from the group consisting of SEQ ID NOs: 1-8, 160, 230, 243-251, 260, 775-792, and 813-822. In some embodiments, the IL-2 polypeptide or functional fragment thereof comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 1-8, 160, 243-251, 260, 775-792, and 813-822. In some embodiments, the IL-2 polypeptide or functional fragment thereof comprises the amino acid sequence of SEQ ID NO: 230. In some embodiments, the IL-2 polypeptide or functional fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 230. In some embodiments, the IL-2 polypeptide or functional fragment thereof comprises the amino acid sequence of SEQ ID NO: 3. In some embodiments, the IL-2 polypeptide or functional fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 3.

In some embodiments, the IL-2 polypeptide or functional fragment thereof comprises an amino acid sequence produced by at least one amino acid modification to an amino acid sequence selected from the group consisting of SEQ ID NOs: 1-8, 160, 230, 243-251, 260, 775-792, and 813-822. Each of the at least one amino acid modifications can be any amino acid modification, such as a substitution, insertion, or deletion. In some embodiments, the IL-2 polypeptide or functional fragment thereof comprises an amino acid sequence produced by at least 1, at least 2, at least 3, at least 4, at least 5, at least 6, at least 7, at least 8, at least 9, or at least 10 amino acid substitutions in the amino acid sequence of any one of SEQ ID NOs: 1-8, 160, 230, 243-251, 260, 775-792, and 813-822. In some embodiments, the IL-2 peptide or functional fragment thereof comprises an amino acid sequence that comprises a serine (S), glycine (G), or alanine (A) residue at amino acid residue 125. In some embodiments the IL-2 peptide or functional fragment thereof comprises an amino acid sequence that comprises an alanine (A) residue at amino acid residue 3. For example, in some embodiments, the IL-2 peptide or functional fragment thereof comprises an amino acid sequence produced by introducing a T3A amino acid substitution to an amino acid sequence selected from the group consisting of SEQ ID NOs: 1-8 and 160. In some embodiments, the IL-2 peptide or functional fragment thereof comprises an amino acid sequence selected from the group consisting of SEQ ID NOs: 243-251 and 260. In some embodiments, the IL-2 peptide or functional fragment thereof comprises an amino acid sequence selected from the group consisting of SEQ ID NOs: 775-792, and 813-822.

In some embodiments, the IL-2 peptide or functional fragment thereof comprises an amino acid sequence having one or more amino acid substitutions compared to the amino acid sequence of wildtype IL-2 that reduces the affinity of the IL-2 peptide or functional fragment thereof for IL-2Rα (CD25). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that one or more of amino acid residues 38, 42, 45, and 62 is an alanine (A). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residues 38, 42, 45, and 62 are an alanine (A). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residues 38, 42, 45, and 62 are an alanine (A) and amino acid residue 125 is a serine (S), glycine (G), or alanine (A). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residues 38 and 42 are an alanine (A) and amino acid residue 125 is a serine (S), glycine (G), or alanine (A). In some embodiments, the IL-2 polypeptide or functional fragment thereof comprises an amino acid sequence produced by substituting amino acid residues R38, F42, Y45, and E62 for alanine in the amino acid sequence of SEQ ID NO: 160 or 251. In some embodiments, the IL-2 polypeptide or functional fragment thereof comprises an amino acid sequence produced by substituting amino acid residues R38, F42, Y45, and E62 for alanine (A) and by substituting amino acid residue C125 for serine (S), glycine (G), or alanine (A) in the amino acid sequence of SEQ ID NO: 160 or 251. In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 42 is lysine (K). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 42 is lysine (K) and amino acid residue 125 is a serine (S), glycine (G), or alanine (A). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residues 42 and 45 are alanine (A) and amino acid residue 72 is glycine (G). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residues 42 and 45 are alanine (A), amino acid residue 72 is glycine (G), and amino acid residue 125 is a serine (S), glycine (G), or alanine (A). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 62 is an arginine (R) or serine (S). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 42 is glutamic acid (E). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 43 is alanine (A). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 45 is asparagine (N), arginine (R), or alanine (A). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 45 is alanine (A) and amino acid residue 62 is serine (S). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 42 is serine (S), amino acid residue 62 is serine (S). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 38 is glycine (G), amino acid residue 45 is alanine (A), and amino acid residue 62 is serine (S).

In some embodiments, the IL-2 peptide or functional fragment thereof comprises an amino acid sequence produced by introducing one or more of the following amino acid substitutions into any one of SEQ ID NOs: 1-8, 160, 243-251, 260, 775-792, and 813-822: R38A, F42A, F42E, F42K, K43A, Y45A, Y45N, Y45R, E62A, E62R, E62S, L72G, C125S, C125G, and C125A.

In some embodiments, the IL-2 polypeptide or functional fragment thereof comprises an amino acid sequence having one or more amino acid substitutions compared to the amino acid sequence of wildtype IL-2 that enhances the affinity of the IL-2 polypeptide or functional fragment thereof for IL-2Rβ (CD122). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 80 is phenylalanine (F), amino acid residue 81 is aspartic acid (D), amino acid residue 85 is valine (V), amino acid residue 86 is valine (V), or amino acid residue 92 is phenylalanine (F), or combinations thereof. In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 80 is phenylalanine (F), amino acid residue 81 is aspartic acid (D), amino acid residue 85 is valine (V), amino acid residue 86 is valine (V), or amino acid residue 92 is phenylalanine (F), or combinations thereof, and amino acid residue 125 is serine (S), glycine (G), or alanine (A). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 80 is phenylalanine (F), amino acid residue 81 is aspartic acid (D), amino acid residue 85 is valine (V), amino acid residue 86 is valine (V), and amino acid residue 92 is phenylalanine (F). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 80 is phenylalanine (F), amino acid residue 81 is aspartic acid (D), amino acid residue 85 is valine (V), amino acid residue 86 is valine (V), amino acid residue 92 is phenylalanine (F), and amino acid residue 125 is serine (S), glycine (G), or alanine (A). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 18 is a cysteine (C). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 20 is an alanine (A), leucine (L), or phenylalanine (F). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 16 is an isoleucine. In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 29 is a leucine (L).

In some embodiments, the IL-2 peptide or functional fragment thereof comprises an amino acid sequence produced by introducing one or more of the following amino acid substitutions into any one of SEQ ID NOs: 1-8, 160, 243-251, 260, 775-792, and 813-822: L18C, D20A, D20L, D20F, H16I, N29L, L80F, R81D, L85V, I86V, I92F, C125S, C125G, and C125A.

In some embodiments, the IL-2 polypeptide or functional fragment thereof comprises an amino acid sequence having one or more amino acid substitutions compared to the amino acid sequence of wildtype IL-2 that reduces the affinity of the IL-2 peptide or functional fragment thereof for IL-2Rα (CD25), and one or more amino acid substitutions compared to the amino acid sequence of wildtype IL-2 that enhances the affinity of the IL-2 polypeptide or functional fragment thereof for IL-2Rβ (CD122). In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that one or more of amino acid residues 38, 42, 45, and 62 is an alanine (A), amino acid residue 42 is lysine (K), amino acid residue 72 is glycine (G), amino acid residue 80 is phenylalanine (F), amino acid residue 81 is aspartic acid (D), amino acid residue 85 is valine (V), amino acid residue 86 is valine (V), or amino acid residue 92 is phenylalanine (F), or combinations thereof. As such, in some embodiments, the IL-2 polypeptide or functional fragment thereof comprises an amino acid sequence that comprises one or more of the following amino acid substitutions compared to the mature form of wildtype IL-2: D20A, D20L, D20F, H16I, L18C, N29L, R38A, F42A, F42E, F42K, K43A, Y45A, Y45N, Y45R, E62A, E62R, E62S, L72G, L80F, R81D, L85V, I86V, I92F, C125S, C125G, and C125A.

In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 38 is a glycine (G), alanine (A), lysine (K), or tryptophan (W), amino acid residue 42 is an alanine (A), lysine (K), or isoleucine (I), amino acid residue 45 is an alanine (A) or asparagine (N), amino acid residue 62 is an alanine (A) or a leucine (L), or amino acid residue 68 is a valine (V), or combinations thereof. In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 38 is a lysine (K), amino acid residue 42 is a glutamine (Q), amino acid residue 45 is a glutamic acid (E), or amino acid residue 68 is a valine (V), or combinations thereof. In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 38 is an alanine (A), amino acid residue 42 is an isoleucine (I), amino acid residue 45 is an asparagine (N), amino acid residue 62 is a leucine (L), or amino acid residue 68 is a valine (V), or combinations thereof. In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 38 is a lysine (K), amino acid residue 42 is a lysine (K), amino acid residue 45 is an arginine (R), amino acid residue 62 is a leucine (L), or amino acid residue 68 is a valine (V), or combinations thereof. In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 38 is an alanine (A) or lysine (K), amino acid residue 42 is an alanine (A), amino acid residue 45 is an alanine (A), or amino acid residue 62 is an alanine (A), or combinations thereof. In some embodiments, the IL-2 polypeptide or functional fragment thereof comprises an amino acid sequence produced by one or more amino acid substitutions in the amino acid sequence of any one of SEQ ID NOs: 1-8, 160, 243-251, 260, 775-792, and 813-822, such that amino acid residue 42 is an isoleucine (I), amino acid residue 45 is a glutamic acid (E), or amino acid residue 68 is a valine (V), or combinations thereof.

In some embodiments, the IL-2 polypeptide or functional fragment thereof comprises an amino acid sequence produced by introducing, or further introducing, a C125S, C125G, or C125A substitution into any one of the amino acid sequences for an IL-2 polypeptide or functional fragment thereof described herein.

In some embodiments, one or more amino acid residues are removed from the amino acid sequence of the IL-2 polypeptide or functional fragment thereof for the purpose of removing an O-glycosylation site. In some embodiments, the IL-2 polypeptide or functional fragment thereof comprises an amino acid sequence produced by deleting the first three amino acid residues (residues 1-3) of the amino acid sequence of any of the IL-2 polypeptides or functional fragments thereof disclosed herein. In some embodiments, one or more amino acid residues are substituted into the amino acid sequence of the IL-2 polypeptide or functional fragment thereof for the purpose of removing an O-glycosylation site. In some embodiments, the IL-2 polypeptide or functional fragment thereof comprises an amino acid sequence produced by introducing amino acid substitutions into one or more of the first three amino acid residues (residues 1-3) of the amino acid sequence of any of the IL-2 polypeptides or functional fragments thereof disclosed herein.

The IL-2 polypeptide or functional fragment thereof comprises an amino-terminus and a carboxy-terminus. In some embodiments, a half-life extension domain is linked to the amino-terminus or the carboxy-terminus of the IL-2 polypeptide or functional fragment thereof. In some embodiments, a masking moiety is linked to the amino-terminus or the carboxy-terminus of the IL-2 polypeptide or functional fragment thereof. In some embodiments, a linker is linked to the amino-terminus or the carboxy-terminus of the IL-2 polypeptide or functional fragment thereof. In some embodiments, a cleavable peptide of a linker is linked to the amino-terminus or the carboxy-terminus of the IL-2 polypeptide or functional fragment thereof. In some embodiments, an N-terminal spacer domain or a C-terminal spacer domain of a linker is linked to the amino-terminus or the carboxy-terminus of the IL-2 polypeptide or functional fragment thereof.

2. IL-15 Polypeptides

In some embodiments, the cytokine or functional fragment thereof is an IL-15 polypeptide or functional fragment thereof. In eukaryotic cells, IL-15 is synthesized as a precursor polypeptide of 162 amino acids, which is then processed into mature IL-15 by the removal of amino acid residues 1-48. This results in a mature form of IL-15 consisting of 114 amino acids (amino acid residues 49-162) that is secreted in a mature, active form (see SEQ ID NO: 167).

In some embodiments, the IL-15 polypeptide or functional fragment thereof is any naturally occurring interleukin-15 (IL-15) protein or modified variant thereof capable of binding to, or otherwise exhibiting affinity for, an interleukin-15 receptor (IL-15R) or component thereof (e.g., the IL-15Rα, IL-2Rβ, and/or IL-2Rγ chain). In some embodiments, the IL-15 polypeptide or functional fragment thereof is a mature form of IL-15 that consists of amino acid residues 49-162 of SEQ ID NO: 166. In some embodiments, the IL-15 polypeptide or functional fragment thereof comprises the amino acid sequence of SEQ ID NO: 167. In some embodiments, the IL-15 polypeptide or functional fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 166 or 167.

In some embodiments, the IL-15 polypeptide or functional fragment thereof comprises an amino acid sequence produced by at least one amino acid modification to the amino acid sequence of SEQ ID NO: 167. Each of the at least one amino acid modifications can be any amino acid modification, such as a substitution, insertion, or deletion. In some embodiments, the IL-15 polypeptide or functional fragment thereof comprises an amino acid sequence produced by at least 1, at least 2, at least 3, at least 4, at least 5, at least 6, at least 7, at least 8, at least 9, or at least 10 amino acid substitutions in the amino acid sequence of SEQ ID NO: 167.

The IL-15 polypeptide or functional fragment thereof comprises an amino-terminus and a carboxy-terminus. In some embodiments, a half-life extension domain is linked to the amino-terminus or the carboxy-terminus of the IL-15 polypeptide or functional fragment thereof. In some embodiments, a masking moiety is linked to the amino-terminus or the carboxy-terminus of the IL-15 polypeptide or functional fragment thereof. In some embodiments, a linker is linked to the amino-terminus or the carboxy-terminus of the IL-15 polypeptide or functional fragment thereof. In some embodiments, a cleavable peptide of a linker is linked to the amino-terminus or the carboxy-terminus of the IL-15 polypeptide or functional fragment thereof. In some embodiments, an N-terminal spacer domain or a C-terminal spacer domain of a linker is linked to the amino-terminus or the carboxy-terminus of the IL-15 polypeptide or functional fragment thereof.

B. Masking Moieties

A masking moiety as provided herein refers to a moiety capable of binding to, or otherwise exhibiting an affinity for, a cytokine or functional fragment thereof such that, in some embodiments, the binding decreases the affinity of the cytokine or functional fragment thereof for its cognate receptor or protein. For example, a masking moiety for an IL-2 polypeptide or functional fragment thereof is capable of binding to, or otherwise exhibiting an affinity for, an IL-2 polypeptide or functional fragment thereof such that, in some embodiments, the binding decreases the affinity of the IL-2 polypeptide or functional fragment thereof for its cognate receptor or protein (e.g., IL-2R or a component thereof, such as the IL-2Rα and/or IL-2Rβ chain). When bound to the cytokine or functional fragment thereof, the masking moiety blocks, occludes, inhibits (e.g. decreases) or otherwise prevents (e.g., masks) the activity or binding of the cytokine or functional fragment thereof to its cognate receptor or protein. In some embodiments that include a first masking moiety and a second masking moiety, the presence of one of the masking moieties (e.g., the first masking moiety) blocks, occludes, inhibits (e.g. decreases) or otherwise prevents (e.g., masks) the activity or binding of the cytokine or functional fragment thereof to its cognate receptor or protein, while the other masking moiety (e.g., the second masking moiety) can, in some embodiments, remain associated with the cytokine or functional fragment thereof following cleavage of the first masking moiety and still allow, or possibly even promote, binding of the cytokine or functional fragment thereof to its cognate receptor or protein at the site where the first masking moiety was bound. See, e.g., FIG. 7B. Methods for determining the extent of binding of a protein (e.g., cytokine) to a cognate protein (e.g., cytokine receptor), is well known in the art.

The masked cytokines provided herein comprise a masking moiety. The masking moiety comprises an amino-terminus and a carboxy-terminus. In some embodiments, the masked cytokine comprises a single masking moiety. In some embodiments, the masked cytokine comprises more than one masking moiety, each of which can be any of the masking moieties described herein. In some embodiments, the masked cytokine comprises a first masking moiety and a second masking moiety. It is understood, for instance, that reference to "a masking moiety" or "the masking moiety" can refer to the masking moiety in a masked cytokine comprising a single masking moiety, or it can refer to the first masking moiety in a masked cytokine comprising a first masking moiety and a second masking moiety, or it can refer to the second masking moiety in a masked cytokine comprising a first masking moiety and a second masking moiety, or it can refer to the first masking moiety and the second masking moiety in a masked cytokine comprising a first masking moiety and a second masking moiety.

In some embodiments, the masking moiety is linked to the cytokine or functional fragment thereof. In some embodiments, the masking moiety is linked to the cytokine or functional fragment thereof via a first linker. In some embodiments, the masked cytokine comprises a half-life extension domain that is linked to the masking moiety. In some embodiments, the masked cytokine comprises a half-life extension domain that is linked to the masking moiety via a second linker. In some embodiments, the masking moiety is linked to the cytokine or functional fragment thereof, and is linked to the half-life extension domain. In some embodiments, the cytokine or functional fragment thereof is linked to the amino-terminus of the masking peptide, and the half-life extension domain is linked to the carboxy-terminus of the masking peptide. In some embodiments, the cytokine or functional fragment thereof is linked to the carboxy-terminus of the masking peptide, and the half-life extension domain is linked to the amino-terminus of the masking peptide. In some embodiments, the half-life extension domain is linked to the amino-terminus or the carboxy-terminus of the masking moiety. In some embodiments, the second linker is linked to the amino-terminus or the carboxy-terminus of the masking moiety. In some embodiments, the masking moiety is linked to the first linker, and is linked to the second linker. In some embodiments, the first linker is linked to the amino-terminus of the masking peptide, and the second linker is linked to the carboxy-terminus of the masking peptide. In some embodiments, the first linker is linked to the carboxy-terminus of the masking peptide, and the second linker is linked to the amino-terminus of the masking peptide.

In some embodiments comprising a first masking moiety and a second masking moiety, the first masking moiety is linked to the cytokine or functional fragment thereof, and the second masking moiety is linked to the cytokine or functional fragment thereof. In some embodiments comprising a first masking moiety and a second masking moiety, the first masking moiety is linked to the cytokine or functional fragment thereof via a first linker, and the second masking moiety is linked to the cytokine or functional fragment thereof via a second linker. In some embodiments, the masked cytokine comprises a half-life extension domain that is linked to either the first masking moiety or the second masking moiety. In some embodiments, the masked cytokine comprises a half-life extension domain that is linked to either the first masking moiety or the second masking moiety via a third linker. In some embodiments, the first linker is linked to the amino-terminus or the carboxy-terminus of the first masking moiety. In some embodiments, the second linker is linked to the amino-terminus or the carboxy-terminus of the second masking moiety. In some embodiments, the half-life extension domain is linked to the amino-terminus or the carboxy-terminus of the first masking moiety. In some embodiments, the half-life extension domain is linked to the amino-terminus or the carboxy-terminus of the second masking moiety. In some embodiments, the third linker is linked to the amino-terminus or the carboxy-terminus of the first masking moiety. In some embodiments, the third linker is linked to the amino-terminus or the carboxy-terminus of the second masking moiety.

In some embodiments comprising a first masking moiety and a second masking moiety, the first masking moiety is linked to the first half-life extension domain, the second masking moiety is linked to the first masking moiety, and the cytokine or functional fragment thereof is linked to the second half-life extension domain. In some embodiments comprising a first masking moiety and a second masking moiety, the first masking moiety is linked to the first half-life extension domain via a first linker, the second masking moiety is linked to the first masking moiety via a second linker, and the cytokine or functional fragment thereof is linked to the second half-life extension domain via a third linker. In some embodiments, the first linker is linked to the amino-terminus or the carboxy-terminus of the first half-life extension domain. In some embodiments, the second linker is linked to the amino-terminus or the carboxy-terminus of the second masking moiety. In some embodiments, the second half-life extension domain is linked to the amino-terminus or the carboxy-terminus of the cytokine or functional fragment thereof. In some embodiments, the first half-life extension domain is linked to the amino-terminus or the carboxy-terminus of the first masking moiety. In some embodiments, the third linker is linked to the amino-terminus or the carboxy-terminus of the second half-life extension domain. In some embodiments, the third linker is linked to the amino-terminus or the carboxy-terminus of the cytokine or functional fragment thereof.

In some embodiments comprising a first masking moiety and a second masking moiety, the second masking moiety is linked to the first half-life extension domain, the first masking moiety is linked to the second masking moiety, and the cytokine or functional fragment thereof is linked to the second half-life extension domain. In some embodiments comprising a first masking moiety and a second masking moiety, the second masking moiety is linked to the first half-life extension domain via a first linker, the first masking moiety is linked to the second masking moiety via a second linker, and the cytokine or functional fragment thereof is linked to the second half-life extension domain via a third linker. In some embodiments, the first linker is linked to the amino-terminus or the carboxy-terminus of the first half-life extension domain. In some embodiments, the second linker is linked to the amino-terminus or the carboxy-terminus of the first masking moiety. In some embodiments, the second half-life extension domain is linked to the amino-terminus or the carboxy-terminus of the cytokine or functional fragment thereof. In some embodiments, the first half-life extension domain is linked to the amino-terminus or the carboxy-terminus of the second masking moiety. In some embodiments, the third linker is linked to the amino-terminus or the carboxy-terminus of the second half-life extension domain. In some embodiments, the third linker is linked to the amino-terminus or the carboxy-terminus of the cytokine or functional fragment thereof.

In some embodiments comprising a first half-life extension domain and a second half-life extension domain, the masking moiety is linked to the first half-life extension domain. In some embodiments, the first half-life extension domain is linked to the amino-terminus or the carboxy-terminus of the masking moiety. In some embodiments, the masking moiety is linked to the first half-life extension domain via a first linker. In some embodiments, the first linker is linked to the amino-terminus or the carboxy-terminus of the masking moiety.

In some embodiments comprising a first half-life extension domain, a second half-life extension domain, a first masking moiety, and a second masking moiety, the first masking moiety is linked to the first half-life extension domain and the second masking moiety is linked to the cytokine or functional fragment thereof. In some embodiments, the second masking moiety is further linked to the second half-life extension domain. In some embodiments, the first masking moiety is linked to the first half-life extension domain via a first linker, and/or either the second masking moiety or the cytokine or functional fragment thereof is linked to the second half-life extension domain via a second linker. In some embodiments, the second masking moiety is linked to the cytokine or functional fragment thereof via a third linker.

In some embodiments, the first half-life extension domain is linked to the amino-terminus or the carboxy-terminus of the first masking moiety. In some embodiments, the cytokine or functional fragment thereof is linked to the amino-terminus or the carboxy-terminus of the second masking moiety. In some embodiments, the first linker is linked to the amino-terminus or the carboxy-terminus of the first masking moiety. In some embodiments, the second linker is linked to the amino-terminus or the carboxy-terminus of the second masking moiety. In some embodiments, the third linker is linked to the amino-terminus or the carboxy-terminus of the second masking moiety. In some embodiments, the second linker is linked to the amino-terminus of the second masking moiety and the third linker is linked to the carboxy-terminus of the second masking moiety. In some embodiments, the second linker is linked to the carboxy-terminus of the second masking moiety and the third linker is linked to the amino-terminus of the second masking moiety.

In some embodiments, the masking moiety comprises an amino acid sequence selected from the group consisting of SEQ ID NOs: 9, 10, 161-165, 187-218, 221-229, 231, and 261. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 9, 10, 161-165, 187-218, 221-229, 231, and 261. In some embodiments, the masking moiety comprises the amino acid sequence of SEQ ID NO: 261. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 261.

In some embodiments, the masked cytokine comprises a first masking moiety and a second masking moiety. In some embodiments, the first masking moiety comprises the amino acid sequence of SEQ ID NO: 9 or 231, and the second masking moiety comprises an amino acid sequence selected from the group consisting of SEQ ID NOs: 10, 161-165, 187-218, 221-229, and 261. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 187-218, 221-229, and 261. In some embodiments, the first masking moiety comprises an amino acid sequence selected from the group consisting of SEQ ID NOs: 10, 161-165, 187-218, 221-229, and 261, and the second masking moiety comprises the amino acid sequence of SEQ ID NO: 9 or 231. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 187-218, 221-229, and 261, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231. In some embodiments, the first masking moiety comprises the amino acid sequence of SEQ ID NO: 9 or 231, and the second masking moiety comprises the amino acid sequence of SEQ ID NO: 261. In some embodiments, the second masking moiety comprises the amino acid sequence of SEQ ID NO: 9 or 231, and the first masking moiety comprises the amino acid sequence of SEQ ID NO: 261. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 261, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231. In some embodiments, the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 261, and the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231.

In some embodiments, the first masking moiety comprises the amino acid sequence of SEQ ID NO: 9 or 231, and the second masking moiety comprises an amino acid sequence selected from the group consisting of SEQ ID NOs: 10, 161-165, 221-226, and 261. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 221-226, and 261. In some embodiments, the first masking moiety comprises an amino acid sequence selected from the group consisting of SEQ ID NOs: 10, 161-165, 221-226, and 261, and the second masking moiety comprises the amino acid sequence of SEQ ID NO: 9 or 231. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 221-226, and 261, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231. In some embodiments, the first masking moiety comprises the amino acid sequence of SEQ ID NO: 9 or 231, and the second masking moiety comprises an amino acid sequence selected from the group consisting of SEQ ID NOs: 10, 161-165, 221-226, 261, 826, and 827. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 221-226, 261, 826, and 827. In some embodiments, the second masking moiety comprises the amino acid sequence of SEQ ID NO: 9 or 231, and the first masking moiety comprises an amino acid sequence selected from the group consisting of SEQ ID NOs: 10, 161-165, 221-226, 261, 826, and 827. In some embodiments, the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231, and the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 221-226, 261, 826, and 827.

In some embodiments, the first masking moiety comprises the amino acid sequence of SEQ ID NO: 9 or 231, and the second masking moiety comprises an amino acid sequence selected from the group consisting of SEQ ID NOs: 187-218. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 187-218. In some embodiments, the first masking moiety comprises an amino acid sequence selected from the group consisting of SEQ ID NOs: 187-218, and the second masking moiety comprises the amino acid sequence of SEQ ID NO: 9 or 231. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 187-218, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231.

In some embodiments, the first masking moiety comprises the amino acid sequence of SEQ ID NO: 9 or 231, and the second masking moiety comprises an amino acid sequence selected from the group consisting of SEQ ID NOs: 227-229. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 227-229. In some embodiments, the first masking moiety comprises an amino acid sequence selected from the group consisting of SEQ ID NOs: 227-229, and the second masking moiety comprises the amino acid sequence of SEQ ID NO: 9 or 231. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 227-229, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9 or 231.

In some embodiments, the first masking moiety comprises the amino acid sequence of SEQ ID NO: 9, and the second masking moiety comprises the amino acid sequence of SEQ ID NO: 10. In some embodiments, the first masking moiety comprises the amino acid sequence of SEQ ID NO: 10, and the second masking moiety comprises the amino acid sequence of SEQ ID NO: 9. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 10. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 10, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 9. In some embodiments, the masking moiety comprises an amino acid sequence produced by one or more of the following amino acid substitutions to SEQ ID NO: 10 or 261: C122S, C168S, R42A, K71A, T73A, T74A, V75A, H133A, Y134A, R137D, Q162W, E170A, and Q188A. In some embodiments, the masking moiety comprising an amino acid sequence that is produced by one or more amino acid substitutions comprises the amino acid sequence of SEQ ID NO: 826.

In some embodiments, the masking moiety comprises an amino acid sequence selected from the group consisting of SEQ ID NOs: 10, 161-165, 219-229, 232-234, 261, and 823-825. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 219-229, 232-234, 261, and 823-825. In some embodiments, the masking moiety comprises the amino acid sequence of SEQ ID NO: 261. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 261. In some embodiments, the masking moiety comprises the amino acid sequence of SEQ ID NO: 826 or 827, or comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 826 or 827.

In some embodiments, the masked cytokine comprises a first masking moiety and a second masking moiety. In some embodiments, the first masking moiety comprises an amino acid sequence selected from the group consisting of SEQ ID NOs: 232-234, and 823-825, and the second masking moiety comprises an amino acid sequence selected from the group consisting of SEQ ID NOs: 10, 161-165, 219-229, and 261. In some embodiments, the first masking moiety comprises an amino acid sequence selected from the group consisting of SEQ ID NOs: 10, 161-165, 219-229, and 261, and the second masking moiety comprises an amino acid sequence selected from the group consisting of SEQ ID NOs: 232-234, and 823-825. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 219-229, and 261, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 232-234, and 823-825. In some embodiments, the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 219-229, and 261, and the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 232-234, and 823-825.

In some embodiments, the first masking moiety comprises an amino acid sequence selected from the group consisting of SEQ ID NOs: 232-234, and 823-825, and the second masking moiety comprises an amino acid sequence selected from the group consisting of SEQ ID NOs: 10, 161-165, 219-229, 261, 826, and 827. In some embodiments, the second masking moiety comprises an amino acid sequence selected from the group consisting of SEQ ID NOs: 232-234, and 823-825, and the first masking moiety comprises an amino acid sequence selected from the group consisting of SEQ ID NOs: 10, 161-165, 219-229, 261, 826, and 827. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 219-229, 261, 826, and 827, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 232-234, and 823-825. In some embodiments, the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 219-229, 261, 826, and 827, and the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 232-234, and 823-825. In some embodiments, the first masking moiety comprises an amino acid sequence selected from the group consisting of SEQ ID NOs: 232-234, and 823-825, and the second masking moiety comprises the amino acid sequence of SEQ ID NO: 826 or 827. In some embodiments, the second masking moiety comprises an amino acid sequence selected from the group consisting of SEQ ID NOs: 232-234, and 823-825, and the first masking moiety comprises the amino acid sequence of SEQ ID NO: 826 or 827.

In some embodiments, the first masking moiety comprises an amino acid sequence selected from the group consisting of SEQ ID NOs: 232-234, and 823-825, and the second masking moiety comprises an amino acid sequence selected from the group consisting of SEQ ID NOs: 10, 161-165, 221-226, and 261. In some embodiments, the first masking moiety comprises an amino acid sequence selected from the group consisting of SEQ ID NOs: 10, 161-165, 221-226, and 261, and the second masking moiety comprises an amino acid sequence selected from the group consisting of SEQ ID NOs: 232-234, and 823-825. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 221-226, and 261, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 232-234, and 823-825. In some embodiments, the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 10, 161-165, 221-226, and 261, and the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 232-234, and 823-825.

In some embodiments, the first masking moiety comprises an amino acid sequence selected from the group consisting of SEQ ID NOs: 232-234, and 823-825, and the second masking moiety comprises an amino acid sequence selected from the group consisting of SEQ ID NOs: 227-229. In some embodiments, the first masking moiety comprises an amino acid sequence selected from the group consisting of SEQ ID NOs: 227-229, and the second masking moiety comprises an amino acid sequence selected from the group consisting of SEQ ID NOs: 232-234, and 823-825. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 227-229, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 232-234, and 823-825. In some embodiments, the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 227-229, and the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 232-234, and 823-825.

In some embodiments, the first masking moiety comprises an amino acid sequence selected from the group consisting of SEQ ID NOs: 232-234, and 823-825, and the second masking moiety comprises an amino acid sequence selected from the group consisting of SEQ ID NOs: 219 and 220. In some embodiments, the first masking moiety comprises an amino acid sequence selected from the group consisting of SEQ ID NOs: 219 and 220, and the second masking moiety comprises an amino acid sequence selected from the group consisting of SEQ ID NOs: 232-234, and 823-825. In some embodiments, the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 219 and 220, and the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 232-234, and 823-825. In some embodiments, the second masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 219 and 220, and the first masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 232-234, and 823-825.

In some embodiments, the masking moiety comprises an amino acid sequence produced by introducing one or more of the following amino acid substitutions into the amino acid sequence of any one of SEQ ID NOs: 232-234, and 823-825: R24A, R26A, K34A, S40A, L42A, and P67A. In some embodiments, the masking moiety comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 232-234, and 823-825 and is further modified by introducing one or more of the following amino acid substitutions into the amino acid sequence having about or at least about 85%, 86%, 87%, 88%, 89%, 90%, 91%, 92%, 93%, 94%, 95%, 96%, 97%, 98%, or 99% sequence identity to the amino acid sequence selected from the group consisting of SEQ ID NOs: 232-234, and 823-825: R24A, R26A, K34A, S40A, L42A, and P67A.

In some embodiments, the masking moiety comprises IL-2Rα (also referred to as CD25) or a fragment, portion, or variant thereof that retains or otherwise demonstrates an affinity to IL-2. In some embodiments, the masking moiety comprises IL-2Rα (also referred to as CD25) or a fragment, portion, or variant thereof and comprises the amino acid sequence of SEQ ID NO: 9 or 231. In some embodiments, the masking moiety comprises IL-2Rβ (also referred to as CD122) or a fragment, portion, or variant thereof that retains or otherwise demonstrates an affinity to IL-2 and/or IL-15. In some embodiments, the masking moiety comprises IL-2Rβ (also referred to as CD122) or a fragment, portion, or variant thereof and comprises an amino acid sequence selected from the group consisting of SEQ ID NOs: 10, 161-165, 221-226, 261, 826, and 827. In some embodiments, the masking moiety comprises IL-2Rγ (also referred to as CD132) or a fragment, portion, or variant thereof that retains or otherwise demonstrates an affinity to IL-2 and/or IL-15. In some embodiments, the masking moiety comprises IL-15Rα (also referred to as CD215) or a fragment, portion, or variant thereof that retains or otherwise demonstrates an affinity to IL-15. In some embodiments, the masking moiety comprises IL-15Rα (also referred to as CD215) or a fragment, portion, or variant thereof and comprises an amino acid sequence selected from the group consisting of SEQ ID NOs: 232-234, and 823-825. In some embodiments, the masking moiety comprises an antigen-binding domain of an antibody or fragment thereof. In some embodiments, the masking moiety comprises an antigen-binding domain of an anti-IL-2 antibody or fragment thereof. In some embodiments, the masking moiety comprises an antigen-binding domain of an anti-IL-15 antibody or fragment thereof.

In some embodiments comprising a first masking moiety and a second masking moiety, the first masking moiety comprises IL-2Rα or a fragment, portion, or variant thereof that retains or otherwise demonstrates an affinity to IL-2, and the second masking moiety comprises IL-2Rβ or a fragment, portion, or variant thereof that retains or otherwise demonstrates an affinity to IL-2. In some embodiments comprising a first masking moiety and a second masking moiety, the first masking moiety comprises IL-2Rβ or a fragment, portion, or variant thereof that retains or otherwise demonstrates an affinity to IL-2, and the second masking moiety comprises IL-2Rα or a fragment, portion, or variant thereof that retains or otherwise demonstrates an affinity to IL-2. In some embodiments comprising a first masking moiety and a second masking moiety, the first masking moiety comprises IL-2Rα or a fragment, portion, or variant thereof that retains or otherwise demonstrates an affinity to IL-2, and the second masking moiety comprises IL-2Rγ or a fragment, portion, or variant thereof that retains or otherwise demonstrates an affinity to IL-2. In some embodiments comprising a first masking moiety and a second masking moiety, the first masking moiety comprises IL-2Rγ or a fragment, portion, or variant thereof that retains or otherwise demonstrates an affinity to IL-2, and the second masking moiety comprises IL-2Rα or a fragment, portion, or variant thereof that retains or otherwise demonstrates an affinity to IL-2. In some embodiments comprising a first masking moiety and a second masking moiety, the first masking moiety comprises IL-2Rα or a fragment, portion, or variant thereof that retains or otherwise demonstrates an affinity to IL-2, and the second masking moiety comprises an antigen-binding domain of an anti-IL-2 antibody or fragment thereof. In some embodiments comprising a first masking moiety and a second masking moiety, the first masking moiety comprises an antigen-binding domain of an anti-IL-2 antibody or fragment thereof, and the second masking moiety comprises IL-2Rα or a fragment, portion, or variant thereof that retains or otherwise demonstrates an affinity to IL-2.

In some embodiments comprising a first masking moiety and a second masking moiety, the first masking moiety comprises IL-15Rα or a fragment, portion, or variant thereof that retains or otherwise demonstrates an affinity to IL-15, and the second masking moiety comprises IL-2Rβ or a fragment, portion, or variant thereof that retains or otherwise demonstrates an affinity to IL-15. In some embodiments comprising a first masking moiety and a second masking moiety, the first masking moiety comprises IL-2Rβ or a fragment, portion, or variant thereof that retains or otherwise demonstrates an affinity to IL-15, and the second masking moiety comprises IL-15Rα or a fragment, portion, or variant thereof that retains or otherwise demonstrates an affinity to IL-15. In some embodiments comprising a first masking moiety and a second masking moiety, the first masking moiety comprises IL-15Rα or a fragment, portion, or variant thereof that retains or otherwise demonstrates an affinity to IL-15, and the second masking moiety comprises IL-2Rγ or a fragment, portion, or variant thereof that retains or otherwise demonstrates an affinity to IL-15. In some embodiments comprising a first masking moiety and a second masking moiety, the first masking moiety comprises IL-2Rγ or a fragment, portion, or variant thereof that retains or otherwise demonstrates an affinity to IL-15, and the second masking moiety comprises IL-15Rα or a fragment, portion, or variant thereof that retains or otherwise demonstrates an affinity to IL-15. In some embodiments comprising a first masking moiety and a second masking moiety, the first masking moiety comprises IL-15Rα or a fragment, portion, or variant thereof that retains or otherwise demonstrates an affinity to IL-15, and the second masking moiety comprises an antigen-binding domain of an anti-IL-15 antibody or fragment thereof. In some embodiments comprising a first masking moiety and a second masking moiety, the first masking moiety comprises an antigen-binding domain of an anti-IL-15 antibody or fragment thereof, and the second masking moiety comprises IL-15Rα or a fragment, portion, or variant thereof that retains or otherwise demonstrates an affinity to IL-15.

C. Linkers

A linker as provided herein refers to a peptide of two more amino acids that is used to link two components together, such as two components of any of the masked cytokines described herein. In some embodiments, the linker comprises a cleavable peptide. In some embodiments, the linker comprises an amino-terminal spacer domain (N-terminal spacer domain) and/or a carboxy-terminal spacer domain (C-terminal spacer domain). In some embodiments, the linker comprises an N-terminal spacer domain, a cleavable peptide, and/or a C-terminal spacer domain. In some embodiments, the linker consists of an N-terminal spacer domain. In some embodiments, the linker consists of a C-terminal spacer domain. In some embodiments, the linker consists of an N-terminal spacer domain and a C-terminal spacer domain. In some embodiments, the linker consists of a cleavable peptide. In some embodiments, the linker consists of an N-terminal spacer domain, a cleavable peptide, and a C-terminal spacer domain. In some embodiments, the linker consists of an N-terminal spacer domain and a cleavable peptide. In some embodiments, the linker consists of a cleavable peptide and a C-terminal spacer domain. In some embodiments, the linker consists of a cleavable peptide.

In some embodiments, the masked cytokine comprises a linker. In some embodiments, the masked cytokine comprises a single linker. In some embodiments, the masked cytokine comprises more than one linker, each of which can be any of the linkers described herein. In some embodiments, the masked cytokine comprises a first linker and a second linker. In some embodiments, the masked cytokine comprises a first linker, a second linker, and a third linker. In some embodiments, the masked cytokine comprises a first linker, a second linker, a third linker, and a fourth linker. For example, reference to "a linker" or "the linker" can refer to the linker in a masked cytokine comprising a single linker, or it can refer to the first linker in a masked cytokine comprising a first linker and a second linker, or it can refer to the second linker in a masked cytokine comprising a first linker and a second linker, or it can refer to the first linker and the second linker in a masked cytokine comprising a first linker and a second linker, or it can refer to the first linker, the second linker, and/or the third linker in a masked cytokine comprising a first linker, a second linker, and a third linker, or it can refer to the first linker, the second linker, the third linker, and/or the fourth linker in a masked cytokine comprising a first linker, a second linker, a third linker, and a fourth linker.

It is understood that each of the following terms are considered a "linker" as described herein: a linker, a first linker, a second linker, a third linker, and a fourth linker, as well as any other numbered linker (e.g., a fifth linker, a sixth linker, etc.). As such, in some embodiments, the masked cytokine may comprise a linker, a first linker, a second linker, a third linker, and/or a fourth linker, each of which is considered "a linker" as described herein, and any of the linkers described herein may be a linker, a first linker, a second linker, a third linker, and/or a fourth linker as described herein.

It is also understood that two components "linked" together includes embodiments in which the two components are directly linked together as well as embodiments in which the two components are linked together via a linker as described herein. For example, "a half-life extension domain that is linked to the masking moiety" is interpreted to mean either that the amino acid sequence of the half-life extension domain is linked directly to the amino acid sequence of the masking moiety, or that the amino acid sequence of the half-life extension domain is linked to the amino acid sequence of the masking moiety via a linker, such as any of the linkers described herein.

The linker comprises an amino-terminus and a carboxy-terminus. In some embodiments, a masking moiety is linked to the amino-terminus or the carboxy-terminus of the linker. In some embodiments, a cytokine or functional fragment thereof is linked to the amino-terminus or the carboxy-terminus of the linker. In some embodiments, a cytokine or functional fragment thereof is linked to the amino-terminus of the linker, and a masking moiety is linked to the carboxy-terminus of the linker. In some embodiments, a cytokine or functional fragment thereof is linked to the carboxy-terminus of the linker, and a masking moiety is linked to the amino-terminus of the linker. In some embodiments, a half-life extension domain is linked to the amino-terminus or the carboxy-terminus of the linker. In some embodiments, a half-life extension domain is linked to the amino-terminus of the linker, and a masking moiety is linked to the carboxy-terminus of the linker. In some embodiments, a half-life extension domain is linked to the carboxy-terminus of the linker, and a masking moiety is linked to the amino-terminus of the linker. In some embodiments, a half-life extension domain is linked to the amino-terminus of the linker, and a cytokine or functional fragment thereof is linked to the carboxy-terminus of the linker. In some embodiments, a half-life extension domain is linked to the carboxy-terminus of the linker, and a cytokine or functional fragment thereof is linked to the amino-terminus of the linker.

In some embodiments comprising a first masking moiety and a second masking moiety that are each linked to a cytokine or functional fragment thereof, the first masking moiety or the second masking moiety is linked to the amino-terminus of a linker, and the cytokine or functional fragment thereof is linked to the carboxy-terminus of the linker. In some embodiments comprising a first masking moiety and a second masking moiety that are each linked to a cytokine or functional fragment thereof, the first masking moiety or the second masking moiety is linked to the carboxy-terminus of a linker, and the cytokine or functional fragment thereof is linked to the amino-terminus of the linker.

In some embodiments comprising a first half-life extension domain and a second half-life extension domain, a masking moiety is linked to the amino-terminus of a linker, and either the first half-life extension domain or the second half-life extension domain is linked to the carboxy-terminus of the linker. In some embodiments comprising a first half-life extension domain and a second half-life extension domain, a masking moiety is linked to the carboxy-terminus of the linker, and either the first half-life extension domain or the second half-life extension domain is linked to the amino-terminus of the linker. In some embodiments comprising a first half-life extension domain and a second half-life extension domain, a cytokine or functional fragment thereof is linked to the amino-terminus of the linker, and either the first half-life extension domain or the second half-life extension domain is linked to the carboxy-terminus of the linker. In some embodiments comprising a first half-life extension domain and a second half-life extension domain, a cytokine or functional fragment thereof is linked to the carboxy-terminus of the linker, and either the first half-life extension domain or the second half-life extension domain is linked to the amino-terminus of the linker.

In some embodiments comprising a first masking moiety linked to a first half-life extension domain, a second masking moiety linked to a cytokine or functional fragment thereof, and where either the second masking moiety or the cytokine or functional fragment thereof is linked to the second half-life extension domain, the first masking moiety is linked to the amino-terminus of the linker and the first half-life extension domain is linked to the carboxy-terminus of the linker. In some embodiments comprising a first masking moiety linked to a first half-life extension domain, a second masking moiety linked to a cytokine or functional fragment thereof, and where either the second masking moiety or the cytokine or functional fragment thereof is linked to the second half-life extension domain, the first masking moiety is linked to the carboxy-terminus of the linker and the first half-life extension domain is linked to the amino-terminus of the linker. In some embodiments comprising a first masking moiety linked to a first half-life extension domain, a second masking moiety linked to a cytokine or functional fragment thereof, and where either the second masking moiety or the cytokine or functional fragment thereof is linked to the second half-life extension domain, the second masking moiety is linked to the amino-terminus of the linker and the cytokine or functional fragment thereof is linked to the carboxy-terminus of the linker. In some embodiments comprising a first masking moiety linked to a first half-life extension domain, a second masking moiety linked to a cytokine or functional fragment thereof, and where either the second masking moiety or the cytokine or functional fragment thereof is linked to the second half-life extension domain, the second masking moiety is linked to the carboxy-terminus of the linker and the cytokine or functional fragment thereof is linked to the amino-terminus of the linker. In some embodiments comprising a first masking moiety linked to a first half-life extension domain, a second masking moiety linked to a cytokine or functional fragment thereof, and where either the second masking moiety or the cytokine or functional fragment thereof is linked to the second half-life extension domain, the second masking moiety is linked to the carboxy-terminus of the linker and the second half-life extension domain is linked to the amino-terminus of the linker. In some embodiments comprising a first masking moiety linked to a first half-life extension domain, a second masking moiety linked to a cytokine or functional fragment thereof, and where either the second masking moiety or the cytokine or functional fragment thereof is linked to the second half-life extension domain, the second masking moiety is linked to the carboxy-terminus of the linker and the second half-life extension domain is linked to the amino-terminus of the linker. In some embodiments comprising a first masking moiety linked to a first half-life extension domain, a second masking moiety linked to a cytokine or functional fragment thereof, and where either the second masking moiety or the cytokine or functional fragment thereof is linked to the second half-life extension domain, the cytokine or functional fragment thereof is linked to the amino-terminus of the linker and the second half-life extension domain is linked to the carboxy-terminus of the linker. In some embodiments comprising a first masking moiety linked to a first half-life extension domain, a second masking moiety linked to a cytokine or functional fragment thereof, and where either the second masking moiety or the cytokine or functional fragment thereof is linked to the second half-life extension domain, the cytokine or functional fragment thereof is linked to the carboxy-terminus of the linker and the second half-life extension domain is linked to the amino-terminus of the linker.

In some embodiments comprising a first masking moiety linked to a first half-life extension domain via a first linker, a second masking moiety linked to the first masking moiety via second linker, and a cytokine or functional fragment thereof linked to a second half-life extension domain via a third linker, the first masking moiety is linked to the carboxy-terminus of the first linker and the first half-life extension domain is linked to the amino-terminus of the first linker, the second masking moiety is linked to the carboxy-terminus of the second linker and the first masking moiety is linked to the amino-terminus of the second linker, and the cytokine or functional fragment thereof is linked to the carboxy-terminus of the third linker and the second half-life extension domain is linked to the amino-terminus of the third linker.

In some embodiments comprising a first masking moiety linked to a first half-life extension domain via a first linker, a second masking moiety linked to the first masking moiety via second linker, and a cytokine or functional fragment thereof linked to a second half-life extension domain via a third linker, the first masking moiety is linked to the amino-terminus of the first linker and the first half-life extension domain is linked to the carboxy-terminus of the first linker, the second masking moiety is linked to the amino-terminus of the second linker and the first masking moiety is linked to the carboxy-terminus of the second linker, and the cytokine or functional fragment thereof is linked to the amino-terminus of the third linker and the second half-life extension domain is linked to the carboxy-terminus of the third linker.

In some embodiments comprising a second masking moiety linked to a first half-life extension domain via a first linker, a first masking moiety linked to the second masking moiety via second linker, and a cytokine or functional fragment thereof linked to a second half-life extension domain via a third linker, the second masking moiety is linked to the carboxy-terminus of the first linker and the first half-life extension domain is linked to the amino-terminus of the first linker, the first masking moiety is linked to the carboxy-terminus of the second linker and the second masking moiety is linked to the amino-terminus of the second linker, and the cytokine or functional fragment thereof is linked to the carboxy-terminus of the third linker and the second half-life extension domain is linked to the amino-terminus of the third linker.

In some embodiments comprising a second masking moiety linked to a first half-life extension domain via a first linker, a first masking moiety linked to the second masking moiety via second linker, and a cytokine or functional fragment thereof linked to a second half-life extension domain via a third linker, the second masking moiety is linked to the amino-terminus of the first linker and the first half-life extension domain is linked to the carboxy-terminus of the first linker, the first masking moiety is linked to the amino-terminus of the second linker and the second masking moiety is linked to the carboxy-terminus of the second linker, and the cytokine or functional fragment thereof is linked to the amino-terminus of the third linker and the second half-life extension domain is linked to the carboxy-terminus of the third linker.

In some embodiments comprising a first half-life extension domain and a second half-life extension domain, the first half-life extension domain is linked to the second half-life extension domain. In some embodiments comprising a first half-life extension domain and a second half-life extension domain, the first half-life extension domain is linked to the second half-life extension domain via a linker.

In some embodiments, the linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812. In some embodiments, the linker comprises an amino acid sequence selected from the group consisting of SEQ ID NOs: 20-153, 235-242, 264, 268-317, 323-338, 340-347, 356-415, 420-491, 494-501, 504-535, 538-555, 727, 794, and 799. In some embodiments, the linker comprises an amino acid sequence selected from the group consisting of SEQ ID NOs: 11-19, 262, 263, 318-320, 348-354, 416-419, 492, 493, 502, 503, 536, 537, 668, 691, 724, 725, 762-771, 797, 798, and 800-812. In some embodiments, the linker comprises the amino acid sequence of SEQ ID NO: 262. In some embodiments, the linker comprises the amino acid sequence of SEQ ID NO: 28. In some embodiments, the linker comprises an amino acid sequence selected from the group consisting of SEQ ID NOs: 20-95, 235, 268, and 269. In some embodiments, the linker comprises an amino acid sequence selected from the group consisting of SEQ ID NOs: 20-33. In some embodiments, the linker comprises an amino acid sequence selected from the group consisting of SEQ ID NOs: 34-44. In some embodiments, the linker comprises an amino acid sequence selected from the group consisting of SEQ ID NOs: 45-95. In some embodiments, the linker comprises the amino acid sequence of SEQ ID NO: 235. In some embodiments, the linker comprises the amino acid sequence of SEQ ID NO: 28. In some embodiments, the linker comprises the amino acid sequence of SEQ ID NO: 268. In some embodiments, the linker comprises the amino acid sequence of SEQ ID NO: 269. In some embodiments, the linker comprises an amino acid sequence selected from the group consisting of SEQ ID NOs: 263, 318-322, 339, 348-355, 416-419, 492, 493, 502, 503, 536, 537, 668, 691, 724, 725, 727, 762-771, 794, 795, and 797-812.

In some embodiments, the linker comprises an amino acid sequence selected from the group consisting of SEQ ID NOs: 794, 795, and 797-812. In some embodiments, the linker comprises an amino acid sequence selected from the group consisting of SEQ ID NOs: 270-302, 306-317, 342-347, 356-415, 420-491, 494-501, 504-535, and 538-555.

In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 11-19, 262, 263, 318-320, 348-354, 416-419, 492, 493, 502, 503, 536, 537, 668, 691, 724, 725, 762-771, 797, 798, and 800-812. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 20-33. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 34-44. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 45-95. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 235. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 262. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 263, 318-320, 348-354, 416-419, 492, 493, 502, 503, 536, 537, 668, 691, 724, 725, 762-771, 797, 798, and 800-812. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 318-320. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 348-354. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 416-419. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 492, 493, 502, 503, 536, 537. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 668, 691, 724, 725, 762-771, 797, 798, and 800-812. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 762-771, 797, 798, and 800-812. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 762-771. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 797, 798, and 800-812. In some embodiments, the linker comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 800-812.

The cleavable peptides and spacer domains of some embodiments of the linker are described in more detail below.

1. Cleavable Peptides

In some embodiments, the linker comprises a cleavable peptide. In some embodiments having more than one linker that comprises a cleavable peptide, a cleavable peptide may be referred to as a first cleavable peptide, a second cleavable peptide, or a third cleavable peptide, each of which is considered "a cleavable peptide" and may be any of the cleavable peptides described herein. For example, reference to "a cleavable peptide" or "the cleavable peptide" can refer to the cleavable peptide in a masked cytokine comprising a single cleavable peptide, or it can refer to the first cleavable peptide in a masked cytokine comprising a first cleavable peptide and a second cleavable peptide, or it can refer to the second cleavable peptide in a masked cytokine comprising a first cleavable peptide and a second cleavable peptide, or it can refer to the first cleavable peptide and the second cleavable peptide in a masked cytokine comprising a first cleavable peptide and a second cleavable peptide, or it can refer to the first cleavable peptide, the second cleavable peptide, and/or the third cleavable peptide in a masked cytokine comprising a first cleavable peptide, a second cleavable peptide, and a third cleavable peptide. It is conceivable that, in some embodiments, more than three cleavable peptides may be present in accordance with the teachings herein.

A cleavable peptide is a polypeptide that includes a cleavage site, such as a protease cleavage site. In some embodiments, the cleavable peptide comprises more than one cleavage site. A "cleavage site" as used herein refers to a recognizable site for cleavage of a portion of the cleavable peptide found in any of the linkers that comprise a cleavable peptide described herein. Thus, a cleavage site may be found in the sequence of a cleavable peptide as described herein. In some embodiments, the cleavage site is an amino acid sequence that is recognized and cleaved by a cleaving agent. Exemplary cleaving agents include proteins, enzymes, DNAzymes, RNAzymes, metals, acids, and bases.

In some embodiments, the cleavable peptide comprises a protease cleavage site. In some embodiments, the protease cleavage site is a tumor-associated protease cleavage site. A "tumor-associated protease cleavage site" as provided herein is an amino acid sequence recognized by a protease whose expression is specific or upregulated for a tumor cell or tumor cell environment thereof. In some embodiments, the protease cleavage site is a cleavage site recognized by one or more enzyme selected from the group consisting of: ABHD12, ADAM12, ABHD12B, ABHD13, ABHD17A, ADAM19, ADAM20, ADAM21, ADAM28, ADAM30, ADAM33, ADAM8, ABHD17A, ADAMDEC1, ADAMTS1, ADAMTS10, ADAMTS12, ADAMTS13, ADAMTS14, ADAMTS15, ADAMTS16, ADAMTS17, ADAMTS18, ADAMTS19, ADAMTS2, ADAMTS20, ADAMTS3, ADAMTS4, ABHD17B, ADAMTS5, ADAMTS6, ADAMTS7, ADAMTS8, ADAMTS9, ADAMTSL1, ADAMTSL2, ADAMTSL3, ABHD17C, ADAMTSL5, ASTL, BMP1, CELA1, CELA2A, CELA2B, CELA3A, CELA3B, ADAM10, ADAM15, ADAM17, ADAM9, ADAMTS4, CTSE, CTSF, ADAMTSL4, CMA1, CTRB1, CTRC, CTSO, CTR1, CTSA, CTSW, CTSB, CTSC, CTSD, ESP1, CTSG, CTSH, GZMA, GZMB, GZMH, CTSK, GZMM, CTSL, CTSS, CTSV, CTSZ, HTRA4, KLK10, KLK11, KLK13, KLK14, KLK2, KLK4, DPP4, KLK6, KLK7, KLKB1, ECE1, ECE2, ECEL1, MASP2, MEP1A, MEP1B, ELANE, FAP, GZMA, MMP11, GZMK, HGFAC, HPN, HTRA1, MMP11, MMP16, MMP17, MMP19, HTRA2, MMP20, MMP21, HTRA3, HTRA4, KEL, MMP23B, MMP24, MMP25, MMP26, MMP27, MMP28, KLK5, MMP3, MMP7, MMP8, MMP9, LGMN, LNPEP, MASP1, PAPPA, PAPPA2, PCSK1, NAPSA, PCSK5, PCSK6, MME, MMP1, MMP10, PLAT, PLAU, PLG, PRSS1, PRSS12, PRSS2, PRSS21, PRSS3, PRSS33, PRSS4, PRSS55, PRSS57, MMP12, PRSS8, PRSS9, PRTN3, MMP13, MMP14, ST14, TMPRSS10, TMPRSS11A, TMPRSS11D, TMPRSS11E, TMPRSS11F, TMPRSS12, TMPRSS13, MMP15, TMPRSS15, MMP2, TMPRSS2, TMPRSS3, TMPRSS4, TMPRSS5, TMPRSS6, TMPRSS7, TMPRSS9, NRDC, OVCH1, PAMR1, PCSK3, PHEX, TINAG, TPSAB1, TPSD1, and TPSG1. In some embodiments, the protease cleavage site is a cleavage site recognized by one or more enzyme selected from the group consisting of: ADAM17, HTRA1, PRSS1, FAP, GZMK, NAPSA, MMP1, MMP2, MMP9, MMP10, MMP7, MMP12, MMP28, ADAMTS9, HGFAC, and HTRA3.

In embodiments, the protease cleavage site is a matrix metalloprotease (MMP) cleavage site, a disintegrin and metalloprotease domain-containing (ADAM) metalloprotease cleavage site, a prostate specific antigen (PSA) protease cleavage site, a urokinase-type plasminogen activator (uPA) protease cleavage site, a membrane type serine protease 1 (MT-SP1) protease cleavage site, a matriptase protease cleavage site (ST14) or a legumain protease cleavage site. In embodiments, the matrix metalloprotease (MMP) cleavage site is a MMP9 cleavage site, a MMP13 cleavage site or a MMP2 cleavage site. In embodiments, the disintegrin and metalloprotease domain-containing (ADAM) metalloprotease cleavage site is an ADAM9 metalloprotease cleavage site, a ADAM10 metalloprotease cleavage site or a ADAM17 metalloprotease cleavage site. Protease cleavage sites may be designated by a specific amino acid sequence.

In some embodiments, the cleavable peptide is cleaved by one or more enzyme selected from the group consisting of: ABHD12, ADAM12, ABHD12B, ABHD13, ABHD17A, ADAM19, ADAM20, ADAM21, ADAM28, ADAM30, ADAM33, ADAM8, ABHD17A, ADAMDEC1, ADAMTS1, ADAMTS10, ADAMTS12, ADAMTS13, ADAMTS14, ADAMTS15, ADAMTS16, ADAMTS17, ADAMTS18, ADAMTS19, ADAMTS2, ADAMTS20, ADAMTS3, ADAMTS4, ABHD17B, ADAMTS5, ADAMTS6, ADAMTS7, ADAMTS8, ADAMTS9, ADAMTSL1, ADAMTSL2, ADAMTSL3, ABHD17C, ADAMTSL5, ASTL, BMP1, CELA1, CELA2A, CELA2B, CELA3A, CELA3B, ADAM10, ADAM15, ADAM17, ADAM9, ADAMTS4, CTSE, CTSF, ADAMTSL4, CMA1, CTRB1, CTRC, CTSO, CTR1, CTSA, CTSW, CTSB, CTSC, CTSD, ESP1, CTSG, CTSH, GZMA, GZMB, GZMH, CTSK, GZMM, CTSL, CTSS, CTSV, CTSZ, HTRA4, KLK10, KLK11, KLK13, KLK14, KLK2, KLK4, DPP4, KLK6, KLK7, KLKB1, ECE1, ECE2, ECEL1, MASP2, MEP1A, MEP1B, ELANE, FAP, GZMA, MMP11, GZMK, HGFAC, HPN, HTRA1, MMP11, MMP16, MMP17, MMP19, HTRA2, MMP20, MMP21, HTRA3, HTRA4, KEL, MMP23B, MMP24, MMP25, MMP26, MMP27, MMP28, KLK5, MMP3, MMP7, MMP8, MMP9, LGMN, LNPEP, MASP1, PAPPA, PAPPA2, PCSK1, NAPSA, PCSK5, PCSK6, MME, MMP1, MMP10, PLAT, PLAU, PLG, PRSS1, PRSS12, PRSS2, PRSS21, PRSS3, PRSS33, PRSS4, PRSS55, PRSS57, MMP12, PRSS8, PRSS9, PRTN3, MMP13, MMP14, ST14, TMPRSS10, TMPRSS11A, TMPRSS11D, TMPRSS11E, TMPRSS11F, TMPRSS12, TMPRSS13, MMP15, TMPRSS15, MMP2, TMPRSS2, TMPRSS3, TMPRSS4, TMPRSS5, TMPRSS6, TMPRSS7, TMPRSS9, NRDC, OVCH1, PAMR1, PCSK3, PHEX, TINAG, TPSAB1, TPSD1, and TPSG1. In some embodiments, the cleavable peptide is cleaved by one or more enzyme selected from the group consisting of: ADAM17, HTRA1, PRSS1, FAP, GZMK, NAPSA, MMP1, MMP2, MMP9, MMP10, MMP7, MMP12, MMP28, ADAMTS9, HGFAC, and HTRA3. In some embodiments, the cleavable peptide is cleaved by one or more enzyme selected from the group consisting of uPA and MMP14. In some embodiments, the cleavable peptide is cleaved by one or more enzyme selected from the group consisting of matriptase and MMP14. In some embodiments, the cleavable peptide is cleaved by one or more enzyme selected from the group consisting of legumain and MMP14. In some embodiments, the cleavable peptide is cleaved by one or more enzyme selected from the group consisting of matriptase and uPA. In some embodiments, the cleavable peptide is cleaved by one or more enzyme selected from the group consisting of uPA and legumain. In some embodiments, the cleavable peptide is cleaved by one or more enzyme selected from the group consisting of matriptase and legumain. In some embodiments, the cleavable peptide is cleaved by one or more enzyme selected from the group consisting of uPA, matriptase, and MMP14. In some embodiments, the cleavable peptide is cleaved by one or more enzyme selected from the group consisting of uPA, legumain, and MMP14. In some embodiments, the cleavable peptide is cleaved by one or more enzyme selected from the group consisting of matriptase, legumain, and MMP14. In some embodiments, the cleavable peptide is cleaved by one or more enzyme selected from the group consisting of matriptase, legumain, and uPA.

In some embodiments, the cleavable peptide is a substrate for a protease that is co-localized in a region or a tissue expressing a cytokine receptor. The cytokine receptor can be any cytokine receptor. In some embodiments, the cytokine receptor is selected from the group consisting of CXCR1, CXCR2, CXCR3, CXCR4, CXCR5, CXCR6, CXCR7, CCR1, CCR2, CCR3, CCR4, CCR5, CCR6, CCR7, CCR8, CCR9, CCR10, CCR11, XCR1, CX3CR1, IL-1RAP, IL-1RAPL1, IL-1RAPL2, IL-1RL1, IL-1RL2, IL-1R1, IL-1R2, IL-2R, IL-2Rα, IL-2Rβ, IL-2Rγ, IL-3Rα, IL-4R, IL-5Rα, IL-6R, IL-6ST, IL-7R, IL-9R, IL-10Rα, IL-10Rβ, IL-11Rα, IL-12Rβ1, IL-12Rβ2, IL-13Rα1, IL-13Rα2, IL-15Rα, IL-17RA, IL-17RB, IL-17RC, IL-17RD, IL-17RE, IL-18RAP, IL-18R1, IL-20Rα, IL-20Rβ, IL-21R, IL-22Rα1, IL-22Rα2, IL-23R, IL-27Rα, IL-28Rα, IL-31RA, IFNAR1, IFNAR2, IFNGR1, IFNGR2, IFNLR1, GMRα (CD116), CD131, GHR, PRLR, EPOR, LIFR (CD118), OSMRβ, TPO-R (CD110), CSF-1R, EDAR, TNFRSF1A, TNFRSF1B, LTBR, TNFRSF4, CD40, FAS, TNFRSF6B, CD27, TNFRSF8, TNFRSF9, TNFRSF10A, TNFRSF10B, TNFRSF10C, TNFRSF10D, TNFRSF11A, TNFRSF11B, TNFRSF12A, TNFRSF13B, TNFRSF13C, TNFRSF14, NGFR, TNFRSF17, TNFRSF18, TNFRSF19, RELT, TNFRSF21, TNFRSF25, and EDA2R.

In some embodiments, the cleavable peptide is a 5-mer (i.e. peptide 5 amino acids in length), 6-mer (i.e. peptide 6 amino acids in length), 7-mer (i.e. peptide 7 amino acids in length), 8-mer (i.e. peptide 8 amino acids in length), 9-mer (i.e. peptide 9 amino acids in length), 10-mer (i.e. peptide 10 amino acids in length), 11-mer (i.e. peptide 11 amino acids in length), 12-mer (i.e. peptide 12 amino acids in length), 13-mer (i.e. peptide 13 amino acids in length), 14-mer (i.e. peptide 14 amino acids in length), 15-mer (i.e. peptide 15 amino acids in length), 16-mer (i.e. peptide 16 amino acids in length), 17-mer (i.e. peptide 17 amino acids in length), or 18-mer (i.e. peptide 18 amino acids in length). Exemplary cleavable peptide sequences are shown in Table 1.

TABLE 1

| Exemplary cleavable peptide sequences | |
|---|---|
| Exemplary cleavable peptide sequences | |
| MPYDLYHP (SEQ ID NO: 96) | GGIGQLTSVLMAAP (SEQ ID NO: 129) |
| GGIGQLTA (SEQ ID NO: 97) | DSGGFMLTLVLPVLP (SEQ ID NO: 130) |
| DLGRFQTF (SEQ ID NO: 98) | TSEFVFAPDLGRFQTF (SEQ ID NO: 131) |
| DSGGFMLT (SEQ ID NO: 99) | TSTSGRSANPR (SEQ ID NO: 132) |

TABLE 1-continued

Exemplary cleavable peptide sequences

| | |
|---|---|
| TSVLMAAP (SEQ ID NO: 100) | TSTSGRSANPG (SEQ ID NO: 133) |
| TSEFVFAPDQ (SEQ ID NO: 101) | TSTSGRSANPH (SEQ ID NO: 134) |
| KLVLPVLP (SEQ ID NO: 102) | VPLSLY (SEQ ID NO: 135) |
| KPILFFRL (SEQ ID NO: 103) | TSASGASASAA (SEQ ID NO: 136) |
| ANQLKG (SEQ ID NO: 104) | PSSPGGGSSP (SEQ ID NO: 137) |
| QSQLKE (SEQ ID NO: 105) | ISSGLLSGRSDNH (SEQ ID NO: 138) |
| HEQLTV (SEQ ID NO: 106) | ISSGLLSGRSDDH (SEQ ID NO: 139) |
| PANLVAPDP (SEQ ID NO: 107) | ISSGLLSGRSDIH (SEQ ID NO: 140) |
| PAPGVYPGP (SEQ ID NO: 108) | ISSGLLSGRSDQH (SEQ ID NO: 141) |
| APAGLIVPYN (SEQ ID NO: 109) | ISSGLLSGRSDTH (SEQ ID NO: 142) |
| PQALVA (SEQ ID NO: 110) | ISSGLLSGRSANP (SEQ ID NO: 143) |
| VGNLNF (SEQ ID NO: 111) | ISSGLLSGRSDNP (SEQ ID NO: 144) |
| VANLLYE (SEQ ID NO: 112) | ISSGLLSGRSANPRG (SEQ ID NO: 145) |
| VYNLMD (SEQ ID NO: 113) | AVGLLAPPGGLSGRSDNH (SEQ ID NO: 146) |
| TFNIKQ (SEQ ID NO: 114) | AVGLLAPPGGLSGRSDDH (SEQ ID NO: 147) |
| DLWKLLP (SEQ ID NO: 115) | AVGLLAPPGGLSGRSDIH (SEQ ID NO: 148) |
| PGSTKRA (SEQ ID NO: 116) | AVGLLAPPGGLSGRSDQH (SEQ ID NO: 149) |
| QQYRALKS (SEQ ID NO: 117) | AVGLLAPPGGLSGRSDTH (SEQ ID NO: 150) |
| YVPRAVL (SEQ ID NO: 118) | AVGLLAPPGGLSGRSANP (SEQ ID NO: 151) |
| GVNKWPT (SEQ ID NO: 119) | AVGLLAPPGGLSGRSDNP (SEQ ID NO: 152) |
| LAQAVRSS (SEQ ID NO: 120) | AVGLLAPPSGRSANPRG (SEQ ID NO: 153) |
| RAAAVKSP (SEQ ID NO: 121) | SGRSA (SEQ ID NO: 236) |
| DLLAVVAAS (SEQ ID NO: 122) | SGRSANA (SEQ ID NO: 237) |
| VQTVTWPD (SEQ ID NO: 123) | SGRNAQ (SEQ ID NO: 238) |
| AIPMSIPP (SEQ ID NO: 124) | SGRNAQVR (SEQ ID NO: 239) |
| GYEVHHQK (SEQ ID NO: 125) | SGRSDN (SEQ ID NO: 240) |
| VHHQKLVF (SEQ ID NO: 126) | SGRSDNPN (SEQ ID NO: 241) |
| IRRVSYSF (SEQ ID NO: 127) | GSGKSA (SEQ ID NO: 242) |
| MPYDLYHPILFFRL (SEQ ID NO: 128) | DSGGFMLTS (SEQ ID NO: 264) |
| ISSGLLGGLSGRSDQP (SEQ ID NO: 270) | IYDQKT (SEQ ID NO: 342) |
| ISSGLLSGRSDQG (SEQ ID NO: 271) | AHNYKT (SEQ ID NO: 343) |
| ISSGLLSGRSDQA (SEQ ID NO: 272) | MMDQAN (SEQ ID NO: 344) |
| ISSGLLSGRSDSP (SEQ ID NO: 273) | MLGEFVSE (SEQ ID NO: 345) |
| ISSGLLSGRSDTP (SEQ ID NO: 274) | GLVALRGA (SEQ ID NO: 346) |
| ISSGLLSGRSDMP (SEQ ID NO: 275) | KEHKYKAE (SEQ ID NO: 347) |
| ISSGLLSGRSD (SEQ ID NO: 276) | RQARVVG (SEQ ID NO: 356) |
| ISSGLLSGRSDQP (SEQ ID NO: 277) | LGGSGRSNAQVRLE (SEQ ID NO: 357) |
| ISSGLLGGLSGRSDNP (SEQ ID NO: 278) | LGGSGRKASLSLE (SEQ ID NO: 358) |

TABLE 1-continued

Exemplary cleavable peptide sequences

| | |
|---|---|
| ISSGLLSSGGLSGRSDQP (SEQ ID NO: 279) | SGRIGFLRTA (SEQ ID NO: 359) |
| ISSGLLSSGGLSGRSDNP (SEQ ID NO: 280) | SGAIGFLRTA (SEQ ID NO: 360) |
| ISSGLLSGRS (SEQ ID NO: 281) | RPARSGRSAGGSVA (SEQ ID NO: 361) |
| ISSGLLSGRSESP (SEQ ID NO: 282) | VTGRGDSPASS (SEQ ID NO: 362) |
| ISSGLLSGRSEQP (SEQ ID NO: 283) | PRFKIIGG (SEQ ID NO: 363) |
| ISSGLLSGRSEQH (SEQ ID NO: 284) | LSGRIGFLRTA (SEQ ID NO: 364) |
| LSSGLLSGRSDQP (SEQ ID NO: 285) | LSGRSNAMPYDLYHP (SEQ ID NO: 365) |
| LSSGLLGGLSGRSDQP (SEQ ID NO: 286) | LSGRSNAGGIGQLTA (SEQ ID NO: 366) |
| LSSGLLSGRSDQG (SEQ ID NO: 287) | LSGRSNAVPLSLY (SEQ ID NO: 367) |
| LSSGLLSGRSDQA (SEQ ID NO: 288) | LSGRSNADSGGFMLT (SEQ ID NO: 368) |
| LSSGLLSGRSDSP (SEQ ID NO: 289) | LSGRSNAHEQLTA (SEQ ID NO: 369) |
| LSSGLLSGRSDTP (SEQ ID NO: 290) | LSGRSNARAAAVKSP (SEQ ID NO: 370) |
| LSSGLLSGRSDMP (SEQ ID NO: 291) | LSGRSNATSVLMAAP (SEQ ID NO: 371) |
| LSSGLLSGRSD (SEQ ID NO: 292) | VPLSLYLSGRSNA (SEQ ID NO: 372) |
| GKQLRVVNEYSSMDNMLLG (SEQ ID NO: 293) | DSGGFMLTLSGRSNA (SEQ ID NO: 373) |
| LSSGLLGGLSGRSDNP (SEQ ID NO: 294) | GGIGQLTALSGRSNA (SEQ ID NO: 374) |
| LSSGLLSSGGLSGRSDQP (SEQ ID NO: 295) | MPYDLYHPLSGRSNA (SEQ ID NO: 375) |
| LSSGLLSSGGLSGRSDNP (SEQ ID NO: 296) | HEQLTVLSGRSNA (SEQ ID NO: 376) |
| GKQLRVVNEYSSEDNMLLG (SEQ ID NO: 297) | RAAAVKSPLSGRSNA (SEQ ID NO: 377) |
| LSSGLLSGRSESP (SEQ ID NO: 298) | TSVLMAAPLSGRSNA (SEQ ID NO: 378) |
| LSSGLLSGRSEQP (SEQ ID NO: 299) | IPVSLRSGRSNAQRLE (SEQ ID NO: 379) |
| LSSGLLSGRSEQH (SEQ ID NO: 300) | VPLSLYRQARVVG (SEQ ID NO: 380) |
| MPYDLYH (SEQ ID NO: 301) | DSGGFMLTRQARVVG (SEQ ID NO: 381) |
| LSGRSDNH (SEQ ID NO: 302) | GGIGQLTARQARVVG (SEQ ID NO: 382) |
| GSIPVSLRSG (SEQ ID NO: 306) | MPYDLYHPRQARVVG (SEQ ID NO: 383) |
| GPSGPAGLKGAPG (SEQ ID NO: 307) | HEQLTVRQARVVG (SEQ ID NO: 384) |
| GPPGPAGMKGLPG (SEQ ID NO: 308) | RAAAVKSPRQARVVG (SEQ ID NO: 385) |
| GYVADAPK (SEQ ID NO: 309) | TSVLMAAPRQARVVG (SEQ ID NO: 386) |
| KKLADEPE (SEQ ID NO: 310) | KQLRVVNEYSSMDNMLLG (SEQ ID NO: 387) |
| GGSRPAHLRDSGK (SEQ ID NO: 311) | KQLRVVNEYSSEDNMLLG (SEQ ID NO: 388) |
| SFTQARVVGG (SEQ ID NO: 312) | KQLRVVNGYSSEDNMLLG (SEQ ID NO: 389) |
| VHMPLGFLGPRQARVVN (SEQ ID NO: 313) | KQLRVVGGLVHLKNTMET (SEQ ID NO: 390) |
| LSGRSDNHSPLGLAGS (SEQ ID NO: 314) | TRDRLDEVNFKQLRVVNG (SEQ ID NO: 391) |
| VPLSLYSG (SEQ ID NO: 315) | TRDRLDEVNFKLLRVVNG (SEQ ID NO: 392) |
| IPESLRAG (SEQ ID NO: 316) | TRDRLDPVNFKQLRVVNG (SEQ ID NO: 393) |
| IPVSLRSG (SEQ ID NO: 317) | TRDRLDPVNFKLLRVVNG (SEQ ID NO: 394) |
| TYSRSKYLATA (SEQ ID NO: 399) | NPMGSEPVNFKQLRVVNG (SEQ ID NO: 395) |
| TYSRSRYLATA (SEQ ID NO: 400) | NPMGSEPVNFKLLRVVNG (SEQ ID NO: 396) |
| KQLRVVNEYSSE (SEQ ID NO: 401) | NPMGSDPVNFKQLRVVNG (SEQ ID NO: 397) |

TABLE 1-continued

Exemplary cleavable peptide sequences

| | |
|---|---|
| KQLRVVNGYSSE (SEQ ID NO: 402) | NPMGSDPVNFKLLRVVNG (SEQ ID NO: 398) |
| KQLRVVGGLVAL (SEQ ID NO: 403) | AGQPKQLRVVNG (SEQ ID NO: 494) |
| KQLRVVNGLVAL (SEQ ID NO: 404) | AGQPLQLRVVNG (SEQ ID NO: 495) |
| SPGRVVGGLVAL (SEQ ID NO: 405) | AGQPLQERVVNG (SEQ ID NO: 496) |
| PQPRTYSRSRYL (SEQ ID NO: 406) | AGQPKQERVVNG (SEQ ID NO: 497) |
| PQPRTTSRSRYL (SEQ ID NO: 407) | GTANKQLRVVNG (SEQ ID NO: 498) |
| VVNEYSSSRGPYH (SEQ ID NO: 408) | GTANKQLHVVNG (SEQ ID NO: 499) |
| VVNEYSSERGPYH (SEQ ID NO: 409) | GTANIQLRVVNG (SEQ ID NO: 500) |
| NKVSMSSSRGPYH (SEQ ID NO: 410) | GTANIQLHVVNG (SEQ ID NO: 501) |
| NKVSMSSTRGPYH (SEQ ID NO: 411) | KQLRTVAGLAGK (SEQ ID NO: 504) |
| APAMMRGSVILTV (SEQ ID NO: 412) | KQLRTVNGLAGK (SEQ ID NO: 505) |
| APAMMEGSVILTV (SEQ ID NO: 413) | KQLRVVAGLAGK (SEQ ID NO: 506) |
| RGSVIITVQTVTW (SEQ ID NO: 414) | KQLRVVNGLAGK (SEQ ID NO: 507) |
| RGSVILTVQTVTW (SEQ ID NO: 415) | GIKYKQLRVVNG (SEQ ID NO: 508) |
| RKGKALAAYRLE (SEQ ID NO: 420) | GIKYKYLRVVNG (SEQ ID NO: 509) |
| RKGKAGAAYRLE (SEQ ID NO: 421) | GIKYLQLRVVNG (SEQ ID NO: 510) |
| RQARVVGGLVAL (SEQ ID NO: 422) | GIKYLYLRVVNG (SEQ ID NO: 511) |
| GGVRGPRFKIIGG (SEQ ID NO: 423) | THLDLTYSRSKYLATA (SEQ ID NO: 512) |
| GGVRGPRVKIIGG (SEQ ID NO: 424) | THLDLTPSRSKYLATA (SEQ ID NO: 513) |
| VTGRGDSHSLTTN (SEQ ID NO: 425) | THLDLTYSRSRYLATA (SEQ ID NO: 514) |
| VTGRGDSPSLTTN (SEQ ID NO: 426) | THLDLTPSRSRYLATA (SEQ ID NO: 515) |
| TGHGQASQGLLDR (SEQ ID NO: 427) | TYSRSKYLAPANGNAE (SEQ ID NO: 516) |
| TGHGQASSGLLDR (SEQ ID NO: 428) | TYSRSKYLATANGNAE (SEQ ID NO: 517) |
| KQLRVVNENLENY (SEQ ID NO: 429) | TYSRSRYLAPANGNAE (SEQ ID NO: 518) |
| KQLRVVNGNLENY (SEQ ID NO: 430) | TYSRSRYLATANGNAE (SEQ ID NO: 519) |
| SNVNDVANYNFF (SEQ ID NO: 431) | DPVNFKQLRVVNEYSSE (SEQ ID NO: 520) |
| SNVNDVSNYNFF (SEQ ID NO: 432) | DPVNFKQLRVVNGYSSE (SEQ ID NO: 521) |
| IDFNAAQNLYEK (SEQ ID NO: 433) | DPVNFKKLRVVNEYSSE (SEQ ID NO: 522) |
| IDFNAAYNLYEK (SEQ ID NO: 434) | DPVNFKKLRVVNGYSSE (SEQ ID NO: 523) |
| IQWNAGQPLQER (SEQ ID NO: 435) | RKGKAGAAKNLNEKDY (SEQ ID NO: 524) |
| IQWNAPQPLQER (SEQ ID NO: 436) | RKGKAGAAKNLYEKDY (SEQ ID NO: 525) |
| SMDNRLLGLFGE (SEQ ID NO: 437) | RKGKAGAAQNLNEKDY (SEQ ID NO: 526) |
| SMDNMLLGLFGE (SEQ ID NO: 438) | RKGKAGAAQNLYEKDY (SEQ ID NO: 527) |
| VPIDDPQDLLEG (SEQ ID NO: 439) | VTGRGDSHSLTKNQVSL (SEQ ID NO: 528) |
| VPIDDPEDLLEG (SEQ ID NO: 440) | VTGRGDSHSLTTNQVSL (SEQ ID NO: 529) |
| IPENLPPGLPLT (SEQ ID NO: 441) | VTGRGDSPSLTKNQVSL (SEQ ID NO: 530) |
| IPENLPPLLPLT (SEQ ID NO: 442) | VTGRGDSPSLTTNQVSL (SEQ ID NO: 531) |
| QPPSLTKNQVSL (SEQ ID NO: 443) | TGHGQASSERSSNIRTS (SEQ ID NO: 532) |

TABLE 1-continued

Exemplary cleavable peptide sequences

| | |
|---|---|
| QPPSLTRNQVSL (SEQ ID NO: 444) | TGHGQASSERSSNSRTS (SEQ ID NO: 533) |
| DSHSLTKNQVSL (SEQ ID NO: 445) | TGHGQASSERSSTIRTS (SEQ ID NO: 534) |
| DSHSLTTNQVSL (SEQ ID NO: 446) | TGHGQASSERSSTSRTS (SEQ ID NO: 535) |
| KAIQLTKNQVSL (SEQ ID NO: 447) | DPVNFKLLRVVNEYSSE (SEQ ID NO: 538) |
| KAIQLTYNQVSL (SEQ ID NO: 448) | DPVNFKLLRVVNGYSSE (SEQ ID NO: 539) |
| AEPWTNRNTDGS (SEQ ID NO: 449) | DPVNFKQLRVVGGLVAL (SEQ ID NO: 540) |
| AEPWTVRNTDGS (SEQ ID NO: 450) | DPVNFKQLRVVNGLVAL (SEQ ID NO: 541) |
| KQLRVVNG (SEQ ID NO: 451) | DPVNFKLLRVVGGLVAL (SEQ ID NO: 542) |
| KQLRVVTGRGDSP (SEQ ID NO: 452) | DPVNFKLLRVVNGLVAL (SEQ ID NO: 543) |
| KQLRVVNGRGDSP (SEQ ID NO: 453) | KQLRVQNGDSTE (SEQ ID NO: 544) |
| PSSRRRVVRKGVS (SEQ ID NO: 454) | KQLRVVNNDATE (SEQ ID NO: 545) |
| PSSRRRVNRKGVS (SEQ ID NO: 455) | KQLRVVNGDSTE (SEQ ID NO: 546) |
| SPGRVVTGRGDSP (SEQ ID NO: 456) | ISNNKQLRVVNG (SEQ ID NO: 547) |
| SPGRVVGGRGDSP (SEQ ID NO: 457) | ISNNKQLPVVNG (SEQ ID NO: 548) |
| NSGRAVTGRGDSP (SEQ ID NO: 458) | ISNNEQLRVVNG (SEQ ID NO: 549) |
| NSGRAVTYRGDSP (SEQ ID NO: 459) | ISNNEQLPVVNG (SEQ ID NO: 550) |
| TGHGQPSSRRRVN (SEQ ID NO: 460) | KVSNKQLRVVNG (SEQ ID NO: 551) |
| TGHGQASSRRRVN (SEQ ID NO: 461) | KVSNKQLPVVNG (SEQ ID NO: 552) |
| TGHGQSSSRGPYH (SEQ ID NO: 462) | KVSNKALRVVNG (SEQ ID NO: 553) |
| TGHGQASSRGPYH (SEQ ID NO: 463) | KVSNKALPVVNG (SEQ ID NO: 554) |
| RGSVILTKNQVSL (SEQ ID NO: 464) | KQLRVQNNDATE (SEQ ID NO: 555) |
| RGSVILTVNQVSL (SEQ ID NO: 465) | TGHGQRSSNIRTS (SEQ ID NO: 480) |
| SPGRVVGINYWLA (SEQ ID NO: 466) | TGHGQASSNIRTS (SEQ ID NO: 481) |
| SPGRVVGGNYWLA (SEQ ID NO: 467) | TGHGHSSNIANI (SEQ ID NO: 482) |
| SPGRVVGSNKGAI (SEQ ID NO: 468) | TGHGQASSNIANI (SEQ ID NO: 483) |
| SPGRVVGGNKGAI (SEQ ID NO: 469) | TGHGQASRNDYSY (SEQ ID NO: 484) |
| PGARGRAPNHAVV (SEQ ID NO: 470) | TGHGQASSNDYSY (SEQ ID NO: 485) |
| PGARGRAFNHAVV (SEQ ID NO: 471) | KALHVTNRNTDGS (SEQ ID NO: 486) |
| PGARGNAFNNLDR (SEQ ID NO: 472) | KALHVTNINTDGS (SEQ ID NO: 487) |
| PGARGRAFNNLDR (SEQ ID NO: 473) | RVVRKKVSNKALP (SEQ ID NO: 488) |
| VSNKYISNNEQLP (SEQ ID NO: 474) | RVVRKGVSNKALP (SEQ ID NO: 489) |
| VSNKYFSNNEQLP (SEQ ID NO: 475) | RQARVVGINYWLA (SEQ ID NO: 490) |
| KVSNKALHVTNI (SEQ ID NO: 476) | RQARVVGGNYWLA (SEQ ID NO: 491) |
| KVSNKALPVTNI (SEQ ID NO: 477) | |
| VTGRGPSPDVPLT (SEQ ID NO: 478) | |
| VTGRGDSPDVPLT (SEQ ID NO: 479) | |

In some embodiments, the cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555. In some embodiments, the cleavable peptide comprises an amino acid sequence selected from the group consisting of SEQ ID NOs: 270-302, 306-317, 342-347, 356-415, 420-491, 494-501, 504-535, and 538-555. In some embodiments, the cleavable peptide comprises an amino acid sequence selected from the group consisting of SEQ ID NOs: 281, 293, 297, 399-415, 420-491, 494-501, 504-535, and 538-555. In some embodiments, the cleavable peptide comprises the amino acid sequence of SEQ ID NO: 96. In some embodiments, the cleavable peptide comprises the amino acid sequence of SEQ ID NO: 264. In some embodiments, the cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242. In some embodiments, the cleavable peptide comprises an amino acid sequence selected from the group consisting of SEQ ID NOs: 96-131, and 264, and an amino acid sequence selected from the group consisting of SEQ ID NOs: 236-242. In some embodiments, the cleavable peptide comprises an amino acid sequence selected from the group consisting of SEQ ID NOs: 96-131, and an amino acid sequence selected from the group consisting of SEQ ID NOs: 236-242. In embodiments in which the cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242, the two amino acid sequences may be linked in any order. For example, in embodiments in which the cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555, and an amino acid sequence selected from the group consisting of SEQ ID NOs: 236-242, the amino acid sequence selected from the group consisting of SEQ ID NOs: 96-153, 236-242, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555. In some embodiments in which the cleavable peptide comprises an amino acid sequence selected from the group consisting of SEQ ID NOs: 96-131, and 264, and an amino acid sequence selected from the group consisting of SEQ ID NOs: 236-242, the amino acid sequence selected from the group consisting of SEQ ID NOs: 96-131, and 264, comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-131, and 264.

In some embodiments, one or more additional amino acids are incorporated by addition into to the amino acid sequence of the cleavable peptide. In some embodiments, the one or more amino acids that are incorporated by addition into the amino acid sequence of the cleavable peptide are selected from the group consisting of hydrophilic amino acids (e.g., lysine, arginine, histidine, aspartic acid, glutamic acid, serine, threonine, asparagine, or glutamine), hydrophobic amino acids (e.g., alanine, valine, isoleucine, leucine, methionine, phenylalanine, tyrosine, tryptophan, cysteine, glycine, or proline), polar amino acids (e.g., serine, threonine, cysteine, asparagine, glutamine, or tyrosine), non-polar amino acids (e.g., glycine, alanine, valine, proline, leucine, isoleucine, methionine, tryptophan, or phenylalanine), amino acids with aliphatic side chains (e.g., glycine, alanine, valine, leucine, or isoleucine), amino acids with hydroxyl-containing side chains (e.g., serine or threonine), amino acids with sulfur-containing side chains (e.g., cysteine or methionine), charged amino acids (e.g., arginine, lysine, aspartic acid, or glutamic acid), uncharged amino acids (e.g., serine, threonine, asparagine, or glutamine), aromatic amino acids (e.g., tyrosine, tryptophan, or phenylalanine), cyclic amino acids (e.g., proline), acidic amino acids (e.g., aspartic acid, asparagine, glutamic acid, or glutamine), basic amino acids (e.g., histidine, lysine, or arginine), and bulky amino acids (e.g., phenylalanine, tyrosine, or tryptophan). In some embodiments, a glycine (G) is incorporated by addition to the N-terminus and/or C-terminus of the amino acid sequence of the cleavable peptide. In some embodiments, a glycine (G) and a proline (P) are incorporated by addition to the N-terminus and/or C-terminus of the amino acid sequence of the cleavable peptide, such as by incorporating the amino acid sequence GP or PG to the N-terminus and/or C-terminus of the amino acid sequence of the cleavable peptide.

The cleavable peptide comprises an amino-terminus and a carboxy-terminus. In some embodiments, the cleavable peptide is linked to an N-terminal spacer domain and/or a C-terminal spacer domain. In some embodiments, an N-terminal spacer domain is linked to the amino-terminus of the cleavable peptide. In some embodiments, a C-terminal spacer domain is linked to the carboxy-terminus of the cleavable peptide. In some embodiments, an N-terminal spacer domain is linked to the amino-terminus of the cleavable peptide, and a C-terminal spacer domain is linked to the carboxy-terminus of the cleavable peptide. In some embodiments, an N-terminal spacer domain is linked to the amino-terminus of the cleavable peptide, and a C-terminal spacer domain is linked to the carboxy-terminus of the cleavable peptide.

In some embodiments, the amino-terminus of the cleavable peptide is linked to a component other than the N-terminal spacer domain. In some embodiments, the carboxy-terminus of the cleavable peptide is linked to a component other than the C-terminal spacer domain. In some embodiments, a masking moiety is linked to the amino-terminus or the carboxy-terminus of the cleavable peptide. In some embodiments, a cytokine or functional fragment thereof is linked to the amino-terminus or the carboxy-terminus of the cleavable peptide. In some embodiments, a half-life extension domain is linked to the amino-terminus or the carboxy-terminus of the cleavable peptide. In some embodiments, a first half-life extension domain is linked to the amino-terminus or the carboxy-terminus of the cleavable peptide. In some embodiments, a second half-life extension domain is linked to the amino-terminus or the carboxy-terminus of the cleavable peptide.

2. Spacer Domains

In some embodiments, the linker comprises a spacer domain. As used herein, a "spacer domain" may, in some embodiments, refer to an N-terminal spacer domain and/or a C-terminal spacer domain. In some embodiments, the linker comprises an N-terminal spacer domain and/or a C-terminal spacer domain. In some embodiments, the linker comprises an N-terminal spacer domain. In some embodiments, the linker comprises a C-terminal spacer domain. In some embodiments, the linker comprises an N-terminal spacer domain and a C-terminal spacer domain. In some embodiments, the linker comprises an N-terminal spacer domain and a cleavable peptide. In some embodiments, the linker comprises a cleavable peptide and a C-terminal spacer domain. In some embodiments, the linker comprises an N-terminal spacer domain, a cleavable peptide, and a C-terminal spacer domain.

In some embodiments, such as some embodiments having more than one N-terminal spacer domain, an N-terminal spacer domain may be referred to as a first N-terminal spacer domain, a second N-terminal spacer domain, or a third N-terminal spacer domain, each of which is considered "an N-terminal spacer domain" and may be any of the N-terminal spacer domains described herein. Likewise, in some embodiments, such as some embodiments having more than one C-terminal spacer domain, a C-terminal spacer domain may be referred to as a first C-terminal spacer domain, a second C-terminal spacer domain, or a third C-terminal spacer domain, each of which is considered "a C-terminal spacer domain" and may be any of the C-terminal spacer domains described herein. For example, reference to "an N-terminal spacer domain" or "the N-terminal spacer domain" can refer to the N-terminal spacer domain in a masked cytokine comprising a single N-terminal spacer domain, or it can refer to the first N-terminal spacer domain in a masked cytokine comprising a first N-terminal spacer domain and a second N-terminal spacer domain, or it can refer to the second N-terminal spacer domain in a masked cytokine comprising a first N-terminal spacer domain and a second N-terminal spacer domain, or it can refer to the first N-terminal spacer domain and the second N-terminal spacer domain in a masked cytokine comprising a first N-terminal spacer domain and a second N-terminal spacer domain, or it can refer to the first N-terminal spacer domain, the second N-terminal spacer domain, and/or the third N-terminal spacer domain in a masked cytokine comprising a first N-terminal spacer domain, a second N-terminal spacer domain, and a third N-terminal spacer domain.

The N-terminal spacer domain and the C-terminal spacer domain each comprise an amino-terminus and a carboxy-terminus. In some embodiments, a masking moiety is linked to the amino-terminus or the carboxy-terminus of the N-terminal spacer domain. In some embodiments, a cytokine or functional fragment thereof is linked to the amino-terminus or the carboxy-terminus of the N-terminal spacer domain. In some embodiments, a half-life extension domain is linked to the amino-terminus or the carboxy-terminus of the N-terminal spacer domain. In some embodiments, a first half-life extension domain is linked to the amino-terminus or the carboxy-terminus of the N-terminal spacer domain. In some embodiments, a second half-life extension domain is linked to the amino-terminus or the carboxy-terminus of the N-terminal spacer domain.

In some embodiments, a masking moiety is linked to the amino-terminus or the carboxy-terminus of the C-terminal spacer domain. In some embodiments, a cytokine or functional fragment thereof is linked to the amino-terminus or the carboxy-terminus of the C-terminal spacer domain. In some embodiments, a half-life extension domain is linked to the amino-terminus or the carboxy-terminus of the C-terminal spacer domain. In some embodiments, a first half-life extension domain is linked to the amino-terminus or the carboxy-terminus of the C-terminal spacer domain. In some embodiments, a second half-life extension domain is linked to the amino-terminus or the carboxy-terminus of the C-terminal spacer domain.

In some embodiments, a masking moiety is linked to the amino-terminus of the N-terminal spacer domain, and a half-life extension domain is linked to the carboxy-terminus of the N-terminal spacer domain. In some embodiments, a cytokine or functional fragment thereof is linked to the amino-terminus of the N-terminal spacer domain, and a half-life extension domain is linked to the carboxy-terminus of the N-terminal spacer domain. In some embodiments, a masking moiety is linked to the carboxy-terminus of the N-terminal spacer domain and, a half-life extension domain is linked to the amino-terminus of the N-terminal spacer domain. In some embodiments, a cytokine or functional fragment thereof is linked to the carboxy-terminus of the N-terminal spacer domain, and a half-life extension domain is linked to the amino-terminus of the N-terminal spacer domain.

In some embodiments, a masking moiety is linked to the amino-terminus of the C-terminal spacer domain, and a half-life extension domain is linked to the carboxy-terminus of the C-terminal spacer domain. In some embodiments, a cytokine or functional fragment thereof is linked to the amino-terminus of the C-terminal spacer domain, and a half-life extension domain is linked to the carboxy-terminus of the C-terminal spacer domain. In some embodiments, a masking moiety is linked to the carboxy-terminus of the C-terminal spacer domain and, a half-life extension domain is linked to the amino-terminus of the C-terminal spacer domain. In some embodiments, a cytokine or functional fragment thereof is linked to the carboxy-terminus of the C-terminal spacer domain, and a half-life extension domain is linked to the amino-terminus of the C-terminal spacer domain.

In some embodiments comprising a first masking moiety and a second masking moiety, the first masking moiety or the second masking moiety is linked to the amino-terminus of the N-terminal spacer domain, and a cytokine or functional fragment thereof is linked to the carboxy-terminus of the N-terminal spacer domain. In some embodiments comprising a first masking moiety and a second masking moiety, the first masking moiety or the second masking moiety is linked to the carboxy-terminus of the N-terminal spacer domain, and a cytokine or functional fragment thereof is linked to the amino-terminus of the N-terminal spacer domain.

In some embodiments comprising a first masking moiety and a second masking moiety, the first masking moiety or the second masking moiety is linked to the amino-terminus of the C-terminal spacer domain, and a cytokine or functional fragment thereof is linked to the carboxy-terminus of the C-terminal spacer domain. In some embodiments comprising a first masking moiety and a second masking moiety, the first masking moiety or the second masking moiety is linked to the carboxy-terminus of the C-terminal spacer domain, and a cytokine or functional fragment thereof is linked to the amino-terminus of the C-terminal spacer domain.

In some embodiments comprising a first masking moiety and a second masking moiety, the first masking moiety is linked to the amino-terminus of the C-terminal spacer domain, and the second masking moiety is linked to the carboxy-terminus of the C-terminal spacer domain. In some embodiments comprising a first masking moiety and a second masking moiety, the first masking moiety is linked to the carboxy-terminus of the C-terminal spacer domain, and the second masking moiety is linked to the amino-terminus of the C-terminal spacer domain.

In some embodiments comprising a first masking moiety and a second masking moiety, the half-life extension domain is linked to the amino-terminus of the N-terminal spacer domain, and either the first masking moiety or the second masking moiety is linked to the carboxy-terminus of the N-terminal spacer domain. In some embodiments comprising a first masking moiety and a second masking moiety, the half-life extension domain is linked to the carboxy-terminus of the N-terminal spacer domain, and either the first masking moiety or the second masking moiety is linked to the amino-terminus of the N-terminal spacer domain.

In some embodiments comprising a first masking moiety and a second masking moiety, the first masking moiety is linked to the amino-terminus of the N-terminal spacer domain, and the second masking moiety is linked to the carboxy-terminus of the N-terminal spacer domain. In some embodiments comprising a first masking moiety and a second masking moiety, the first masking moiety is linked to the carboxy-terminus of the N-terminal spacer domain, and the second masking moiety is linked to the amino-terminus of the N-terminal spacer domain.

In some embodiments comprising a first masking moiety and a second masking moiety, the half-life extension domain is linked to the amino-terminus of the C-terminal spacer domain, and either the first masking moiety or the second masking moiety is linked to the carboxy-terminus of the C-terminal spacer domain. In some embodiments comprising a first masking moiety and a second masking moiety, the half-life extension domain is linked to the carboxy-terminus of the C-terminal spacer domain, and either the first masking moiety or the second masking moiety is linked to the amino-terminus of the C-terminal spacer domain.

In some embodiments comprising a first half-life extension domain and a second half-life extension domain, a masking moiety is linked to the amino-terminus of the N-terminal spacer domain, and either the first half-life extension domain or the second half-life extension domain is linked to the carboxy-terminus of the N-terminal spacer domain. In some embodiments comprising a first half-life extension domain and a second half-life extension domain, a masking moiety is linked to the carboxy-terminus of the N-terminal spacer domain, and either the first half-life extension domain or the second half-life extension domain is linked to the amino-terminus of the N-terminal spacer domain. In some embodiments comprising a first half-life extension domain and a second half-life extension domain, a cytokine or functional fragment thereof is linked to the amino-terminus of the N-terminal spacer domain, and either the first half-life extension domain or the second half-life extension domain is linked to the carboxy-terminus of the N-terminal spacer domain. In some embodiments comprising a first half-life extension domain and a second half-life extension domain, a cytokine or functional fragment thereof is linked to the carboxy-terminus of the N-terminal spacer domain, and either the first half-life extension domain or the second half-life extension domain is linked to the amino-terminus of the N-terminal spacer domain.

In some embodiments comprising a first half-life extension domain and a second half-life extension domain, a masking moiety is linked to the amino-terminus of the C-terminal spacer domain, and either the first half-life extension domain or the second half-life extension domain is linked to the carboxy-terminus of the C-terminal spacer domain. In some embodiments comprising a first half-life extension domain and a second half-life extension domain, a masking moiety is linked to the carboxy-terminus of the C-terminal spacer domain, and either the first half-life extension domain or the second half-life extension domain is linked to the amino-terminus of the C-terminal spacer domain. In some embodiments comprising a first half-life extension domain and a second half-life extension domain, a cytokine or functional fragment thereof is linked to the amino-terminus of the C-terminal spacer domain, and either the first half-life extension domain or the second half-life extension domain is linked to the carboxy-terminus of the C-terminal spacer domain. In some embodiments comprising a first half-life extension domain and a second half-life extension domain, a cytokine or functional fragment thereof is linked to the carboxy-terminus of the C-terminal spacer domain, and either the first half-life extension domain or the second half-life extension domain is linked to the amino-terminus of the C-terminal spacer domain.

In some embodiments comprising a first half-life extension domain, a second half-life extension domain, a first masking moiety, and a second masking moiety, the first masking moiety is linked to the amino-terminus of the N-terminal spacer domain, and the first half-life extension domain is linked to the carboxy-terminus of the N-terminal spacer domain. In some embodiments comprising a first half-life extension domain, a second half-life extension domain, a first masking moiety, and a second masking moiety, the first masking moiety is linked to the carboxy-terminus of the N-terminal spacer domain, and the first half-life extension domain is linked to the amino-terminus of the N-terminal spacer domain. In some embodiments comprising a first half-life extension domain, a second half-life extension domain, a first masking moiety, and a second masking moiety, the first masking moiety is linked to the amino-terminus of the C-terminal spacer domain, and the first half-life extension domain is linked to the carboxy-terminus of the C-terminal spacer domain. In some embodiments comprising a first half-life extension domain, a second half-life extension domain, a first masking moiety, and a second masking moiety, the first masking moiety is linked to the carboxy-terminus of the C-terminal spacer domain, and the first half-life extension domain is linked to the amino-terminus of the C-terminal spacer domain.

In some embodiments comprising a first half-life extension domain, a second half-life extension domain, a first masking moiety, and a second masking moiety, the second masking moiety is linked to the amino-terminus of the N-terminal spacer domain, and the cytokine or functional fragment thereof is linked to the carboxy-terminus of the N-terminal spacer domain. In some embodiments comprising a first half-life extension domain, a second half-life extension domain, a first masking moiety, and a second masking moiety, the second masking moiety is linked to the carboxy-terminus of the N-terminal spacer domain, and the cytokine or functional fragment thereof is linked to the amino-terminus of the N-terminal spacer domain. In some embodiments comprising a first half-life extension domain, a second half-life extension domain, a first masking moiety, and a second masking moiety, the second masking moiety is linked to the amino-terminus of the C-terminal spacer domain, and the cytokine or functional fragment thereof is linked to the carboxy-terminus of the C-terminal spacer domain. In some embodiments comprising a first half-life extension domain, a second half-life extension domain, a first masking moiety, and a second masking moiety, the second masking moiety is linked to the carboxy-terminus of the C-terminal spacer domain, and the cytokine or functional fragment thereof is linked to the amino-terminus of the C-terminal spacer domain.

In some embodiments comprising a first half-life extension domain, a second half-life extension domain, a first masking moiety, and a second masking moiety, the second half-life extension domain is linked to the amino-terminus of the N-terminal spacer domain, and either the cytokine or functional fragment thereof or the second masking moiety is linked to the carboxy-terminus of the N-terminal spacer domain. In some embodiments comprising a first half-life extension domain, a second half-life extension domain, a first masking moiety, and a second masking moiety, the second half-life extension domain is linked to the carboxy-terminus of the N-terminal spacer domain, and either the cytokine or functional fragment thereof or the second masking moiety is linked to the amino-terminus of the N-terminal spacer domain. In some embodiments comprising a first half-life extension domain, a second half-life extension domain, a first masking moiety, and a second masking moiety, the second half-life extension domain is linked to the amino-terminus of the C-terminal spacer domain, and either the cytokine or functional fragment thereof or the second masking moiety is linked to the carboxy-terminus of the C-terminal spacer domain. In some embodiments comprising a first half-life extension domain, a second half-life extension domain, a first masking moiety, and a second masking moiety, the second half-life extension domain is linked to the carboxy-terminus of the C-terminal spacer domain, and either the cytokine or functional fragment thereof or the second masking moiety is linked to the amino-terminus of the C-terminal spacer domain.

In some embodiments comprising a first half-life extension domain and a second half-life extension domain, the first half-life extension domain is linked to the second half-life extension domain via a linker. In some embodiments, the linker linking the first half-life extension domain and the second half-life extension domain comprises an N-terminal spacer domain and/or a C-terminal spacer domain. In some embodiments, the linker linking the first half-life extension domain and the second half-life extension domain comprises a cleavable peptide and an N-terminal spacer domain and/or a C-terminal spacer domain. In some embodiments comprising a first half-life extension domain and a second half-life extension domain that are linked together via a linker, the linker comprises an amino-terminus and a carboxy terminus, and the first half-life extension domain is linked to the amino-terminus of the linker and the second half-life extension domain is linked to the carboxy-terminus of the linker. In some embodiments comprising a first half-life extension domain and a second half-life extension domain that are linked together via a linker, the linker comprises an amino-terminus and a carboxy terminus, and the first half-life extension domain is linked to the carboxy-terminus of the linker and the second half-life extension domain is linked to the amino-terminus of the linker.

In some embodiments, the N-terminal spacer domain comprises an amino acid sequence selected from the group consisting of SEQ ID NOs: 20-95, 235, 268, 269, 303-305, 323-338, 340, 341, 727, 794, and 799. In some embodiments, the C-terminal spacer domain comprises an amino acid sequence selected from the group consisting of SEQ ID NOs: 20-95, 235, 268, 269, 303-305, 323-338, 340, 341, 727, 794, and 799. In some embodiments, the N-terminal spacer domain comprises an amino acid sequence selected from the group consisting of SEQ ID NOs: 20-95, 235, 268, 269, 303-305, 323-338, 340, 341, 727, 794, and 799, and the C-terminal spacer domain comprises an amino acid sequence selected from the group consisting of SEQ ID NOs: 20-95, 235, 268, 269, 303-305, 323-338, 340, 341, 727, 794, and 799.

In some embodiments, the N-terminal spacer domain comprises an amino acid sequence selected from the group consisting of SEQ ID NOs: 20-95, 235, 268, and 269. In some embodiments, the C-terminal spacer domain comprises an amino acid sequence selected from the group consisting of SEQ ID NOs: 20-95, 235, 268, and 269. In some embodiments, the N-terminal spacer domain comprises an amino acid sequence selected from the group consisting of SEQ ID NOs: 20-95, 235, 268, and 269, and the C-terminal spacer domain comprises an amino acid sequence selected from the group consisting of SEQ ID NOs: 20-95, 235, 268, and 269. In some embodiments, the linker comprises an N-terminal spacer domain comprising an amino acid sequence selected from the group consisting of SEQ ID NOs: 20-95, 235, 268, and 269, and an C-terminal spacer domain comprising an amino acid sequence selected from the group consisting of SEQ ID NOs: 20-95, 235, 268, and 269. In some embodiments, the linker comprises an N-terminal spacer domain comprising the amino acid sequence of SEQ ID NO: 268, and an C-terminal spacer domain comprising the amino acid sequence of SEQ ID NO: 269. In some embodiments, the linker comprises an N-terminal spacer domain comprising the amino acid sequence of SEQ ID NO: 268, a cleavable peptide comprising the amino acid sequence of SEQ ID NO: 264, and an C-terminal spacer domain comprising the amino acid sequence of SEQ ID NO: 269. In some embodiments, the linker comprises an N-terminal spacer domain comprising the amino acid sequence of SEQ ID NO: 269, and an C-terminal spacer domain comprising the amino acid sequence of SEQ ID NO: 268. In some embodiments, the linker comprises an N-terminal spacer domain comprising the amino acid sequence of SEQ ID NO: 269, a cleavable peptide comprising the amino acid sequence of SEQ ID NO: 264, and an C-terminal spacer domain comprising the amino acid sequence of SEQ ID NO: 268.

In some embodiments, the N-terminal spacer domain comprises an amino acid sequence selected from the group consisting of SEQ ID NOs: 20-95, 235, 268, and 269. In some embodiments, the N-terminal spacer domain comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of any one of SEQ ID NOs: 20-95, 235, 268, 269, 303-305, 323-338, 340, 341, 727, 794, and 799. In some embodiments, the N-terminal spacer domain comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of any one of SEQ ID NOs: 20-95, 235, 268, and 269. In some embodiments, the C-terminal spacer domain comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of any one of SEQ ID NOs: 20-95, 235, 268, 269, 303-305, 323-338, 340, 341, 727, 794, and 799. In some embodiments, the C-terminal spacer domain comprises an amino acid sequence selected from the group consisting of SEQ ID NOs: 20-95, 235, 268, and 269. In some embodiments, the C-terminal spacer domain comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of any one of SEQ ID NOs: 20-95, 235, 268, and 269. In some embodiments, the N-terminal spacer domain comprises an amino acid sequence selected from the group consisting of SEQ ID NOs: 20-95, 235, 268, and 269, and the C-terminal spacer domain comprises an amino acid sequence selected from the group consisting of SEQ ID NOs: 20-95, 235, 268, and 269. In some embodiments, the N-terminal spacer domain comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of any one of SEQ ID NOs: 20-95, 235, 268, and 269, and the C-terminal spacer domain comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of any one of SEQ ID NOs: 20-95, 235, 268, and 269. In some embodiments, the N-terminal spacer domain comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 268, and the C-terminal spacer domain comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 269. In some embodiments, the N-terminal spacer domain comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 268, the cleavable peptide comprises the amino acid sequence of SEQ ID NO: 264, and the C-terminal spacer domain comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 269. Exemplary spacer domains (e.g., N-terminal spacer domains and/or C-terminal spacer domains) are shown in Table 2.

TABLE 2

| Exemplary spacer domains | |
|---|---|
| PA (SEQ ID NO: 20) | SPGGSS (SEQ ID NO: 74) |
| GGGGSGGGGSGGGGS (SEQ ID NO: 21) | GGPGSSP (SEQ ID NO: 75) |
| PSGPSAGGAA (SEQ ID NO: 22) | SGPPGGPSS (SEQ ID NO: 76) |
| GGPPASAGS (SEQ ID NO: 23) | GPGPGSPPGGSS (SEQ ID NO: 77) |
| GSPPAGGAP (SEQ ID NO: 24) | SGPP (SEQ ID NO: 78) |
| GPGSGSGGAA (SEQ ID NO: 25) | PGSPSSS (SEQ ID NO: 79) |
| GGGGSGGGGS (SEQ ID NO: 26) | PSPGGPS (SEQ ID NO: 80) |
| GGGGSGGGGSGGGGSGGGGS (SEQ ID NO: 27) | GGPPS (SEQ ID NO: 81) |
| PGSGS (SEQ ID NO: 28) | PSPPSS (SEQ ID NO: 82) |
| GGGGGGGGGGGGGGGGGGGGGGGGGGGGGG (SEQ ID NO: 29) | SGGPGP (SEQ ID NO: 83) |
| GGGGSGGGGSGGGGSGGGGSGGGGS (SEQ ID NO: 30) | GPSPGS (SEQ ID NO: 84) |
| GGGGSGGGGSGGGGSGGGGSGGGGSGGGGS (SEQ ID NO: 31) | GSPGPSP (SEQ ID NO: 85) |
| GGGGSGGGGSGGGGSGGGGSGGGGSGGGGSGGGGS (SEQ ID NO: 32) | PSSGGSS (SEQ ID NO: 86) |
| GGGGSGGGGSGGGGSGGGGSGGGGSGGGGSGGGGSGGGGS (SEQ ID NO: 33) | SGSSGP (SEQ ID NO: 87) |
| GGSSPP (SEQ ID NO: 34) | GGSSSPP (SEQ ID NO: 88) |
| SGP (SEQ ID NO: 35) | GSPGSP (SEQ ID NO: 89) |
| GSP (SEQ ID NO: 36) | PPPS (SEQ ID NO: 90) |
| GSPP (SEQ ID NO: 37) | APPPS (SEQ ID NO: 91) |
| GSPS (SEQ ID NO: 38) | AAPPPS (SEQ ID NO: 92) |
| GPPSGSSP (SEQ ID NO: 39) | SAPPPS (SEQ ID NO: 93) |
| GSSGGPPGG (SEQ ID NO: 40) | SSGP (SEQ ID NO: 94) |
| SGSPSGSGGG (SEQ ID NO: 41) | SSPGP (SEQ ID NO: 95) |
| GPPGPPGSSG (SEQ ID NO: 42) | SGGSGGGGSGGGSGGGGSLQ (SEQ ID NO: 235) |
| SGGG (SEQ ID NO: 43) | GSGP (SEQ ID NO: 268) |
| GSSSGPPGPPS (SEQ ID NO: 44) | GPAP (SEQ ID NO: 269) |
| GGS (SEQ ID NO: 45) | SGS (SEQ ID NO: 727) |

TABLE 2-continued

Exemplary spacer domains

| | |
|---|---|
| GGGSSGGS (SEQ ID NO: 46) | SG (SEQ ID NO: 794) |
| GGSGG (SEQ ID NO: 47) | GSG (SEQ ID NO: 799) |
| GGGS (SEQ ID NO: 48) | PGPGP (SEQ ID NO: 323) |
| GS (SEQ ID NO: 48) | SGGCGGHQYERRGGC (SEQ ID NO: 324) |
| GSGGGSSGGS (SEQ ID NO: 50) | SGGCSGHQYERREGC (SEQ ID NO: 325) |
| GSSGGS (SEQ ID NO: 51) | SGGCGGHYFERHGGC (SEQ ID NO: 326) |
| GGGSSGGSG (SEQ ID NO: 52) | SGGCSGHYFERHEGC (SEQ ID NO: 327) |
| GGSAGGS (SEQ ID NO: 53) | SGGCSFHQYERHEGC (SEQ ID NO: 328) |
| GHS (SEQ ID NO: 54) | PSGSS (SEQ ID NO: 329) |
| GPS (SEQ ID NO: 55) | GSPG (SEQ ID NO: 330) |
| GAS (SEQ ID NO: 56) | GGSPGG (SEQ ID NO: 331) |
| SGG (SEQ ID NO: 57) | GGPGGP (SEQ ID NO: 332) |
| SGGSGG (SEQ ID NO: 58) | GGSG (SEQ ID NO: 333) |
| SSG (SEQ ID NO: 59) | GSPPGG (SEQ ID NO: 334) |
| GGGSGG (SEQ ID NO: 60) | GPGSPG (SEQ ID NO: 335) |
| GG (SEQ ID NO: 61) | GSSPPG (SEQ ID NO: 336) |
| GGG (SEQ ID NO: 62) | GGP (SEQ ID NO: 337) |
| SHGG (SEQ ID NO: 63) | SGPGSGS (SEQ ID NO: 338) |
| HGGG (SEQ ID NO: 64) | SGPGSGS (SEQ ID NO: 340) |
| SGAA (SEQ ID NO: 65) | SGSGGSP (SEQ ID NO: 341) |
| SGPA (SEQ ID NO: 66) | GGGSSP (SEQ ID NO: 303) |
| GGSGGS (SEQ ID NO: 67) | SGGP (SEQ ID NO: 304) |
| GGSGGP (SEQ ID NO: 68) | SGPSGSPG (SEQ ID NO: 305) |
| GGSGGG (SEQ ID NO: 69) | |
| GSGGPGPS (SEQ ID NO: 70) | |
| SGPPGSS (SEQ ID NO: 71) | |
| SSGGSGP (SEQ ID NO: 72) | |
| SSPSPSGG (SEQ ID NO: 73) | |

In some embodiments, the N-terminal spacer domain comprises an amino acid sequence produced by modifying the amino acid sequence of any of the N-terminal spacer domains described herein. In some embodiments, the N-terminal spacer domain comprises an amino acid sequence produced by modifying the amino acid sequence of any one of SEQ ID NOs: 20-95, 235, 268, 269, 303-305, 323-338, 340, 341, 727, 794, and 799. In some embodiments, the C-terminal spacer domain comprises an amino acid sequence produced by modifying the amino acid sequence of any of the C-terminal spacer domains described herein. In some embodiments, the C-terminal spacer domain comprises an amino acid sequence produced by modifying the amino acid sequence of any one of SEQ ID NOs: 20-95, 235, 268, 269, 303-305, 323-338, 340, 341, 727, 794, and 799. In some embodiments, the N-terminal spacer domain comprises an amino acid sequence produced by modifying the amino acid sequence of any one of SEQ ID NOs: 20-95, 235, 268, 269, 303-305, 323-338, 340, 341, 727, 794, and 799, and the C-terminal spacer domain comprises an amino acid sequence produced by modifying the amino acid sequence of any one of SEQ ID NOs: 20-95, 235, 268, 269, 303-305, 323-338, 340, 341, 727, 794, and 799. In some embodiments, the N-terminal spacer domain and/or the C-terminal spacer domain comprises the amino acid sequence of SEQ ID NO: 28.

In some embodiments, the N-terminal spacer domain and/or the C-terminal spacer domain consists of one or more amino acids. In some embodiments, the one or more amino acids of the N-terminal spacer domain and/or the C-terminal spacer domain are selected from the group consisting of hydrophilic amino acids (e.g., lysine, arginine, histidine, aspartic acid, glutamic acid, serine, threonine, asparagine, or glutamine), hydrophobic amino acids (e.g., alanine, valine, isoleucine, leucine, methionine, phenylalanine, tyrosine, tryptophan, cysteine, glycine, or proline), polar amino acids (e.g., serine, threonine, cysteine, asparagine, glutamine, or tyrosine), nonpolar amino acids (e.g., glycine, alanine, valine, proline, leucine, isoleucine, methionine, tryptophan, or phenylalanine), amino acids with aliphatic side chains (e.g., glycine, alanine, valine, leucine, or isoleucine), amino acids with hydroxyl-containing side chains (e.g., serine or threonine), amino acids with sulfur-containing side chains (e.g., cysteine or methionine), charged amino acids (e.g., arginine, lysine, aspartic acid, or glutamic acid), uncharged amino acids (e.g., serine, threonine, asparagine, or glutamine), aromatic amino acids (e.g., tyrosine, tryptophan, or phenylalanine), cyclic amino acids (e.g., proline), acidic amino acids (e.g., aspartic acid, asparagine, glutamic acid, or glutamine), basic amino acids (e.g., histidine, lysine, or arginine), and bulky amino acids (e.g., phenylalanine, tyrosine, or tryptophan). In some embodiments, the N-terminal spacer domain and/or the C-terminal spacer domain consists of a glycine (G). In some embodiments, the N-terminal spacer domain and/or the C-terminal spacer domain consists of a glycine (G) and a proline (P), and has the amino acid sequence of GP or PG.

It is understood that a modification to a "spacer domain," as described in some embodiments, can refer to a modification to any one or more of the spacer domains described herein (e.g., any N-terminal spacer domain and/or any C-terminal spacer domain described herein). For example, a modification to a spacer domain can refer to (a) a modification to any N-terminal spacer domain described herein, (b) a modification to any C-terminal spacer domain described herein, or (c) a modification to any N-terminal spacer domain and to any C-terminal spacer domain described herein. As such, any of the linkers described herein that include an N-terminal spacer domain include embodiments where the N-terminal spacer domain is modified in accordance with the modifications described herein, any of the linkers described herein that include a C-terminal spacer domain include embodiments where the C-terminal spacer domain is modified in accordance with the modifications described herein, and any of the linkers described herein that include an N-terminal spacer domain and a C-terminal spacer domain include embodiments where the N-terminal spacer domain and/or the C-terminal spacer domain is/are modified in accordance with the modifications described herein.

The modification to the sequence of the N-terminal spacer domain and/or the C-terminal spacer domain can be any modification to the amino acid sequence of the spacer domain, including the incorporation of any additional amino acid into the sequence, the substitution of any amino acid for a different amino acid, and/or the removal of any amino acid from the sequence.

In some embodiments, one or more additional amino acids are incorporated by addition into to the amino acid sequence of the N-terminal spacer domain and/or the C-terminal spacer domain. In some embodiments, the one or more amino acids that are incorporated by addition into the amino acid sequence of the N-terminal spacer domain and/or the C-terminal spacer domain are selected from the group consisting of hydrophilic amino acids (e.g., lysine, arginine, histidine, aspartic acid, glutamic acid, serine, threonine, asparagine, or glutamine), hydrophobic amino acids (e.g., alanine, valine, isoleucine, leucine, methionine, phenylalanine, tyrosine, tryptophan, cysteine, glycine, or proline), polar amino acids (e.g., serine, threonine, cysteine, asparagine, glutamine, or tyrosine), nonpolar amino acids (e.g., glycine, alanine, valine, proline, leucine, isoleucine, methionine, tryptophan, or phenylalanine), amino acids with aliphatic side chains (e.g., glycine, alanine, valine, leucine, or isoleucine), amino acids with hydroxyl-containing side chains (e.g., serine or threonine), amino acids with sulfur-containing side chains (e.g., cysteine or methionine), charged amino acids (e.g., arginine, lysine, aspartic acid, or glutamic acid), uncharged amino acids (e.g., serine, threonine, asparagine, or glutamine), aromatic amino acids (e.g., tyrosine, tryptophan, or phenylalanine), cyclic amino acids (e.g., proline), acidic amino acids (e.g., aspartic acid, asparagine, glutamic acid, or glutamine), basic amino acids (e.g., histidine, lysine, or arginine), and bulky amino acids (e.g., phenylalanine, tyrosine, or tryptophan).

In some embodiments, one or more amino acids are substituted into the amino acid sequence of the N-terminal spacer domain and/or the C-terminal spacer domain. In some embodiments, the one or more amino acids that are substituted into the amino acid sequence of the spacer domain are selected from the group consisting of hydrophilic amino acids (e.g., lysine, arginine, histidine, aspartic acid, glutamic acid, serine, threonine, asparagine, or glutamine), hydrophobic amino acids (e.g., alanine, valine, isoleucine, leucine, methionine, phenylalanine, tyrosine, tryptophan, cysteine, glycine, or proline), polar amino acids (e.g., serine, threonine, cysteine, asparagine, glutamine, or tyrosine), nonpolar amino acids (e.g., glycine, alanine, valine, proline, leucine, isoleucine, methionine, tryptophan, or phenylalanine), amino acids with aliphatic side chains (e.g., glycine, alanine, valine, leucine, or isoleucine), amino acids with hydroxyl-containing side chains (e.g., serine or threonine), amino acids with sulfur-containing side chains (e.g., cysteine or methionine), charged amino acids (e.g., arginine, lysine, aspartic acid, or glutamic acid), uncharged amino acids (e.g., serine, threonine, asparagine, or glutamine), aromatic amino acids (e.g., tyrosine, tryptophan, or phenylalanine), cyclic amino acids (e.g., proline), acidic amino acids (e.g., aspartic acid, asparagine, glutamic acid, or glutamine), basic amino acids (e.g., histidine, lysine, or arginine), and bulky amino acids (e.g., phenylalanine, tyrosine, or tryptophan).

In some embodiments, the modification to the amino acid sequence of the N-terminal spacer domain and/or the C-terminal spacer domain comprises the substitution of at least one hydrophilic amino acid for a hydrophobic amino acid, the substitution of at least one hydrophobic amino acid for a hydrophilic amino acid, the substitution of at least one polar amino acid for a nonpolar amino acid, the substitution of at least one nonpolar amino acid for a polar amino acid, the substitution of at least one charged amino acid for an uncharged amino acid, the substitution of at least one uncharged amino acid for a charged amino acid, the substitution of at least one acidic amino acid for a basic amino acid, the substitution of at least one basic amino acid for an acidic amino acid, the substitution of at least one non-bulky amino acid for a bulky amino acid, the substitution of at least one bulky amino acid for a non-bulky amino acid, the substitution of at least one amino acid with a hydroxyl-containing side chain or a sulfur-containing side chain for an aliphatic amino acid, the substitution of at least one amino acid with a hydroxyl-containing side chain or a sulfur-containing side chain for an aromatic amino acid, or the substitution of at least one aromatic amino acid for an amino acid with a hydroxyl-containing side chain or a sulfur-containing side chain In some embodiments, the one or more amino acids that are removed from the amino acid sequence of the N-terminal spacer domain and/or the C-terminal spacer domain are selected from the group consisting of hydrophilic amino acids (e.g., lysine, arginine, histidine, aspartic acid, glutamic acid, serine, threonine, asparagine, or glutamine), hydrophobic amino acids (e.g., alanine, valine, isoleucine, leucine, methionine, phenylalanine, tyrosine, tryptophan, cysteine, glycine, or proline), polar amino acids (e.g., serine, threonine, cysteine, asparagine, glutamine, or tyrosine), nonpolar amino acids (e.g., glycine, alanine, valine, proline, leucine, isoleucine, methionine, tryptophan, or phenylalanine), amino acids with aliphatic side chains (e.g., glycine, alanine, valine, leucine, or isoleucine), amino acids with hydroxyl-containing side chains (e.g., serine or threonine), amino acids with sulfur-containing side chains (e.g., cysteine or methionine), charged amino acids (e.g., arginine, lysine, aspartic acid, or glutamic acid), uncharged amino acids (e.g., serine, threonine, asparagine, or glutamine), aromatic amino acids (e.g., tyrosine, tryptophan, or phenylalanine), cyclic amino acids (e.g., proline), acidic amino acids (e.g., aspartic acid, asparagine, glutamic acid, or glutamine), basic amino acids (e.g., histidine, lysine, or arginine), and bulky amino acids (e.g., phenylalanine, tyrosine, or tryptophan).

Any of the modifications to the spacer domains described herein (e.g., any N-terminal spacer domain and/or any C-terminal spacer domain) can be modifications made to the amino acid sequence of any of the N-terminal spacer domains and/or C-terminal spacer domains described herein, including any one of SEQ ID NOs: 20-95, 235, 268, 269, 303-305, 323-338, 340, 341, 727, 794, and 799. Any of the modifications to the spacer domains described herein can be modifications made for any purpose. For instance, modifications to the N-terminal spacer domain and/or the C-terminal spacer domain of a linker that includes a cleavable peptide can be made for the purpose of altering the conformation of the linker such that the efficiency of the cleavage of the cleavable peptide is altered. Modifications to the N-terminal spacer domain and/or the C-terminal spacer domain of a linker that includes a cleavable peptide can also be made for the purpose of altering the structure of a linker that includes a cleavable peptide such that cleavage efficiency of the cleavable peptide is altered under certain pH conditions.

D. Half-life Extension Domains

A long half-life in vivo is important for therapeutic proteins. Unfortunately, cytokines that are administered to a subject generally have a short half-life since they are normally cleared rapidly from the subject by mechanisms including clearance by the kidney and endocytic degradation. Thus, in some embodiments of the masked cytokine provided herein, a half-life extension domain is linked to the masked cytokine for the purpose of extending the half-life of the cytokine in vivo.

In some embodiments, the masked cytokine provided herein comprises a half-life extension domain selected from the group consisting of antibodies and fragments thereof, albumin, albumin-binding proteins, IgG-binding proteins, and polyamino acid sequences. It is contemplated that other mechanisms for extending the half-life of the masked cytokine available in the art may also be employed. The half-life extension domain comprises an amino-terminus and a carboxy-terminus.

In some embodiments, the masked cytokine comprises a half-life extension domain. In some embodiments, the masked cytokine comprises a single half-life extension domain. In some embodiments, the masked cytokine comprises more than one half-life extension domain, each of which can be any of the half-life extension domains described herein. In some embodiments, the masked cytokine comprises a first half-life extension domain and a second half-life extension domain. It is understood that reference to "a half-life extension domain" or "the half-life extension domain" can refer to the half-life extension domain in a masked cytokine comprising a single half-life extension domain, or it can refer to the first half-life extension domain in a masked cytokine comprising a first half-life extension domain and a second half-life extension domain, or it can refer to the second half-life extension domain in a masked cytokine comprising a first half-life extension domain and a second half-life extension domain, or it can refer to the first half-life extension domain and the second half-life extension domain in a masked cytokine comprising a first half-life extension domain and a second half-life extension domain.

In some embodiments comprising a first half-life extension domain and a second half-life extension domain, the first half-life extension domain is linked to the second half-life extension domain. In some embodiments comprising a first half-life extension domain and a second half-life extension domain, the first half-life extension domain is linked to the second half-life extension domain via a linker. The first half-life extension domain and the second half-life extension domain that are linked can, in some embodiments, each be any half-life extension domain described herein. For instance, in some embodiments, the first half-life extension domain and/or the second half-life extension domain of the linked first and second half-life extension domains is an Fc domain or fragment thereof. In some embodiments, the first half-life extension domain and/or the second half-life extension domain of the linked first and second half-life extension domains is an antibody, or a fragment, variant, or derivative thereof.

1. Antibodies and Fragments Thereof

By linking a masked cytokine to an antibody or fragment thereof that is capable of FcRn-mediated recycling, clearance of the masked cytokine from a subject can be reduced or otherwise delayed, thereby prolonging the half-life of the administered masked cytokine.

In some embodiments of the masked cytokine, the half-life extension domain comprises an antibody or fragment thereof. In some embodiments, the masked cytokine comprises more than one antibody or fragment thereof, each of which can be any of the antibodies or fragments thereof described herein. In some embodiments, the masked cytokine comprises a first half-life extension domain and a second half-life extension domain, each of which comprises an antibody or fragment thereof. It is understood that reference to "an antibody or fragment thereof" or "the antibody or fragment thereof" can refer to the antibody or fragment thereof of the half-life extension domain in a masked cytokine comprising a single half-life extension domain, or it can refer to the antibody or fragment thereof of the first half-life extension domain in a masked cytokine comprising a first half-life extension domain and a second half-life extension domain, or it can refer to the antibody or fragment thereof of the second half-life extension domain in a masked cytokine comprising a first half-life extension domain and a second half-life extension domain, or it can refer to the antibody or fragment thereof of the first half-life extension domain and the antibody or fragment thereof of the second half-life extension domain in a masked cytokine comprising a first half-life extension domain and a second half-life extension domain.

The antibody or fragment thereof can be any antibody or fragment thereof. In some embodiments, the antibody or fragment thereof is any antibody or fragment thereof that is capable of FcRn-mediated recycling, such as any heavy chain polypeptide or portion thereof (e.g., Fc domain or fragment thereof) that is capable of FcRn-mediated recycling. However, in some embodiments of a masked cytokine comprising a first half-life extension domain and a second half-life extension domain, either the first half-life extension domain or the second half-life extension domain may comprise an antibody or fragment thereof that does not bind to the FcRn receptor, such as a light chain polypeptide. For example, in some embodiments of the masked cytokine, a first half-life extension domain comprises an antibody or fragment thereof that comprises a light chain polypeptide or portion thereof that does not directly interact with the FcRn receptor, but the masked cytokine nonetheless has an extended half-life due to comprising a second half-life extension domain that is capable of interacting with the FcRn receptor, such as by comprising a heavy chain polypeptide. It is recognized in the art that FcRn-mediated recycling requires binding of the FcRn receptor to the Fc region of the antibody or fragment thereof. For instance, studies have shown that residues I253, S254, H435, and Y436 (numbering according to the Kabat EU index numbering system) are important for the interaction between the human Fc region and the human FcRn complex. See, e.g., Firan, M., et al., Int. Immunol. 13 (2001) 993-1002; Shields, R. L., et al, J. Biol. Chem. 276 (2001) 6591-6604). Various mutants of residues 248-259, 301-317, 376-382, and 424-437 (numbering according to the Kabat EU index numbering system) have also been examined and reported. Yeung, Y. A., et al. (J. Immunol. 182 (2009) 7667-7671.

In some embodiments, the antibody or fragment thereof comprises either a heavy chain polypeptide or a light chain polypeptide. In some embodiments, the antibody or fragment thereof comprises a portion of either a heavy chain polypeptide or a light chain polypeptide. In some embodiments, the antibody or fragment thereof comprises an Fc domain or fragment thereof. In some embodiments, the antibody or fragment thereof comprises a CH2 and CH3 domain or a fragment thereof. In some embodiments, the antibody or fragment thereof comprises the constant domain of the heavy chain polypeptide. In some embodiments, the antibody or fragment thereof comprises the constant domain of the light chain polypeptide. In some embodiments, the antibody or fragment thereof comprises a heavy chain polypeptide or fragment thereof (e.g., an Fc domain or fragment thereof). In some embodiments, the antibody or fragment thereof comprises a light chain polypeptide.

In some embodiments, the heavy chain polypeptide comprises the amino acid sequence of SEQ ID NO: 158. In some embodiments, the light chain polypeptide comprises the amino acid sequence of SEQ ID NO: 157. In some embodiments, the heavy chain polypeptide comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 158. In some embodiments, the heavy chain polypeptide comprises the amino acid sequence of SEQ ID NO: 168. In some embodiments, the heavy chain polypeptide comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 168. In some embodiments, the heavy chain polypeptide comprises the amino acid sequence of SEQ ID NO: 169. In some embodiments, the heavy chain polypeptide comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 169.

In some embodiments, the light chain polypeptide comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 157. In some embodiments, the light chain polypeptide comprises the amino acid sequence of SEQ ID NO: 170. In some embodiments, the light chain polypeptide comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 170.

In some embodiments, the antibody of fragment thereof comprises an Fc domain or fragment thereof. In some embodiments, the antibody of fragment thereof is an Fc domain or fragment thereof.

In some embodiments, the Fc domain or fragment thereof comprises an amino acid sequence selected from the group consisting of SEQ ID NOs: 616, 619, 622, 625, 721,772-774, 793, and 796. In some embodiments, the Fc domain or fragment thereof comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 616, 619, 622, 625, 721,772-774, 793, and 796. In some embodiments, the Fc domain or fragment thereof comprises the amino acid sequence of SEQ ID NO: 154. In some embodiments, the Fc domain or fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 154. In some embodiments, the Fc domain or fragment thereof comprises the amino acid sequence of SEQ ID NO: 155. In some embodiments, the Fc domain or fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 155. In some embodiments, the Fc domain or fragment thereof comprises the amino acid sequence of SEQ ID NO: 156. In some embodiments, the Fc domain or fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156. In some embodiments, the Fc domain or fragment thereof comprises the amino acid sequence of SEQ ID NO: 265. In some embodiments, the Fc domain or fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 265. In some embodiments, the Fc domain or fragment thereof comprises the amino acid sequence of SEQ ID NO: 155. In some embodiments, the Fc domain or fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 155. In some embodiments, the Fc domain or fragment thereof comprises the amino acid sequence of SEQ ID NO: 772, or comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 772. In some embodiments, the Fc domain or fragment thereof comprises the amino acid sequence of SEQ ID NO: 773, or comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 773. In some embodiments, the Fc domain or fragment thereof comprises the amino acid sequence of SEQ ID NO: 774, or comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 774.

In some embodiments comprising a first half-life extension domain and a second half-life extension domain, the first half-life extension domain comprises an Fc domain or fragment thereof comprising an amino acid sequence selected from the group consisting of SEQ ID NOs: 154-156, 265, 616, 619, 622, 625, 721,772-774, 793, and 796, and the second half-life extension domain comprises an Fc domain or fragment thereof comprising an amino acid sequence selected from the group consisting of SEQ ID NOs: 154-156, 265, 616, 619, 622, 625, 721,772-774, 793, and 796. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 154-156, 265, 616, 619, 622, 625, 721,772-774, 793, and 796, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 154-156, 265, 616, 619, 622, 625, 721,772-774, 793, and 796. In some embodiments comprising a first half-life extension domain and a second half-life extension domain, the first half-life extension domain comprises the amino acid sequence of any of the first half-life extension domains listed in Tables 4-11, and the second half-life extension domain comprises the amino acid sequence of any of the first half-life extension domains listed in Tables 4-11.

In some embodiments comprising a first half-life extension domain and a second half-life extension domain, the first half-life extension domain comprises an Fc domain or fragment thereof comprising the amino acid sequence of SEQ ID NO: 155, and the second half-life extension domain comprises an Fc domain or fragment thereof comprising the amino acid sequence of SEQ ID NO: 156. In some embodiments comprising a first half-life extension domain and a second half-life extension domain, the first half-life extension domain comprises an Fc domain or fragment thereof comprising the amino acid sequence of SEQ ID NO: 156, and the second half-life extension domain comprises an Fc domain or fragment thereof comprising the amino acid sequence of SEQ ID NO: 155. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 155, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 155.

In some embodiments comprising a first half-life extension domain and a second half-life extension domain, the first half-life extension domain comprises an Fc domain or fragment thereof comprising the amino acid sequence of SEQ ID NO: 155, and the second half-life extension domain comprises an Fc domain or fragment thereof comprising the amino acid sequence of SEQ ID NO: 616. In some embodiments comprising a first half-life extension domain and a second half-life extension domain, the first half-life extension domain comprises an Fc domain or fragment thereof comprising the amino acid sequence of SEQ ID NO: 616, and the second half-life extension domain comprises an Fc domain or fragment thereof comprising the amino acid sequence of SEQ ID NO: 155. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 155, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 616. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 616, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 155.

In some embodiments comprising a first half-life extension domain and a second half-life extension domain, the first half-life extension domain comprises an Fc domain or fragment thereof comprising the amino acid sequence of SEQ ID NO: 156, and the second half-life extension domain comprises an Fc domain or fragment thereof comprising the amino acid sequence of SEQ ID NO: 265. In some embodiments comprising a first half-life extension domain and a second half-life extension domain, the first half-life extension domain comprises an Fc domain or fragment thereof comprising the amino acid sequence of SEQ ID NO: 265, and the second half-life extension domain comprises an Fc domain or fragment thereof comprising the amino acid sequence of SEQ ID NO: 156. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 265, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 265.

In some embodiments comprising a first half-life extension domain and a second half-life extension domain, the first half-life extension domain comprises an Fc domain or fragment thereof comprising the amino acid sequence of SEQ ID NO: 156, and the second half-life extension domain comprises an Fc domain or fragment thereof comprising the amino acid sequence of SEQ ID NO: 155. In some embodiments comprising a first half-life extension domain and a second half-life extension domain, the first half-life extension domain comprises an Fc domain or fragment thereof comprising the amino acid sequence of SEQ ID NO: 155, and the second half-life extension domain comprises an Fc domain or fragment thereof comprising the amino acid sequence of SEQ ID NO: 156. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 155, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 155.

In some embodiments comprising a first half-life extension domain and a second half-life extension domain, the first half-life extension domain comprises an Fc domain or fragment thereof comprising the amino acid sequence of SEQ ID NO: 721, and the second half-life extension domain comprises an Fc domain or fragment thereof comprising the amino acid sequence of SEQ ID NO: 619. In some embodiments comprising a first half-life extension domain and a second half-life extension domain, the first half-life extension domain comprises an Fc domain or fragment thereof comprising the amino acid sequence of SEQ ID NO: 619, and the second half-life extension domain comprises an Fc domain or fragment thereof comprising the amino acid sequence of SEQ ID NO: 721. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 619, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 721. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 721, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 619.

In some embodiments comprising a first half-life extension domain and a second half-life extension domain, the first half-life extension domain comprises an Fc domain or fragment thereof comprising the amino acid sequence of SEQ ID NO: 721, and the second half-life extension domain comprises an Fc domain or fragment thereof comprising the amino acid sequence of SEQ ID NO: 772. In some embodiments comprising a first half-life extension domain and a second half-life extension domain, the first half-life extension domain comprises an Fc domain or fragment thereof comprising the amino acid sequence of SEQ ID NO: 772, and the second half-life extension domain comprises an Fc domain or fragment thereof comprising the amino acid sequence of SEQ ID NO: 721. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 772, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 721. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 721, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 772.

In some embodiments comprising a first half-life extension domain and a second half-life extension domain, the first half-life extension domain comprises an Fc domain or fragment thereof comprising the amino acid sequence of SEQ ID NO: 793, and the second half-life extension domain comprises an Fc domain or fragment thereof comprising the amino acid sequence of SEQ ID NO: 622. In some embodiments comprising a first half-life extension domain and a second half-life extension domain, the first half-life extension domain comprises an Fc domain or fragment thereof comprising the amino acid sequence of SEQ ID NO: 622, and the second half-life extension domain comprises an Fc domain or fragment thereof comprising the amino acid sequence of SEQ ID NO: 793. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 622, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 793. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 793, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 622.

In some embodiments comprising a first half-life extension domain and a second half-life extension domain, the first half-life extension domain comprises an Fc domain or fragment thereof comprising the amino acid sequence of SEQ ID NO: 793, and the second half-life extension domain comprises an Fc domain or fragment thereof comprising the amino acid sequence of SEQ ID NO: 773. In some embodiments comprising a first half-life extension domain and a second half-life extension domain, the first half-life extension domain comprises an Fc domain or fragment thereof comprising the amino acid sequence of SEQ ID NO: 773, and the second half-life extension domain comprises an Fc domain or fragment thereof comprising the amino acid sequence of SEQ ID NO: 793. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 773, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 793. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 793, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 773.

In some embodiments comprising a first half-life extension domain and a second half-life extension domain, the first half-life extension domain comprises an Fc domain or fragment thereof comprising the amino acid sequence of SEQ ID NO: 796, and the second half-life extension domain comprises an Fc domain or fragment thereof comprising the amino acid sequence of SEQ ID NO: 625. In some embodiments comprising a first half-life extension domain and a second half-life extension domain, the first half-life extension domain comprises an Fc domain or fragment thereof comprising the amino acid sequence of SEQ ID NO: 625, and the second half-life extension domain comprises an Fc domain or fragment thereof comprising the amino acid sequence of SEQ ID NO: 796. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 625, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 796. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 796, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 625.

In some embodiments comprising a first half-life extension domain and a second half-life extension domain, the first half-life extension domain comprises an Fc domain or fragment thereof comprising the amino acid sequence of SEQ ID NO: 796, and the second half-life extension domain comprises an Fc domain or fragment thereof comprising the amino acid sequence of SEQ ID NO: 774. In some embodiments comprising a first half-life extension domain and a second half-life extension domain, the first half-life extension domain comprises an Fc domain or fragment thereof comprising the amino acid sequence of SEQ ID NO: 774, and the second half-life extension domain comprises an Fc domain or fragment thereof comprising the amino acid sequence of SEQ ID NO: 796. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 774, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 796. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 796, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 774.

In some embodiments comprising a first half-life extension domain and a second half-life extension domain, the first half-life extension domain comprises an Fc domain or fragment thereof comprising the amino acid sequence of SEQ ID NO: 793, and the second half-life extension domain comprises an Fc domain or fragment thereof comprising the amino acid sequence of SEQ ID NO: 773. In some embodiments comprising a first half-life extension domain and a second half-life extension domain, the first half-life extension domain comprises an Fc domain or fragment thereof comprising the amino acid sequence of SEQ ID NO: 774 and the second half-life extension domain comprises an Fc domain or fragment thereof comprising the amino acid sequence of SEQ ID NO: 793. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 773, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 793. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 793, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 773.

In some embodiments comprising a first half-life extension domain and a second half-life extension domain, the first half-life extension domain comprises an Fc domain or fragment thereof comprising the amino acid sequence of SEQ ID NO: 796, and the second half-life extension domain comprises an Fc domain or fragment thereof comprising the amino acid sequence of SEQ ID NO: 774. In some embodiments comprising a first half-life extension domain and a second half-life extension domain, the first half-life extension domain comprises an Fc domain or fragment thereof comprising the amino acid sequence of SEQ ID NO: 774, and the second half-life extension domain comprises an Fc domain or fragment thereof comprising the amino acid sequence of SEQ ID NO: 796. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 774, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 796. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 796, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 774.

In some embodiments comprising a first half-life extension domain and a second half-life extension domain, the first half-life extension domain comprises an Fc domain or fragment thereof comprising the amino acid sequence of SEQ ID NO: 156, and the second half-life extension domain comprises an Fc domain or fragment thereof comprising the amino acid sequence of SEQ ID NO: 155. In some embodiments comprising a first half-life extension domain and a second half-life extension domain, the first half-life extension domain comprises an Fc domain or fragment thereof comprising the amino acid sequence of SEQ ID NO: 155, and the second half-life extension domain comprises an Fc domain or fragment thereof comprising the amino acid sequence of SEQ ID NO: 156 In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 155, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 155.

In some embodiments comprising a first half-life extension domain and a second half-life extension domain, the first half-life extension domain comprises an Fc domain or fragment thereof comprising the amino acid sequence of SEQ ID NO: 772, and the second half-life extension domain comprises an Fc domain or fragment thereof comprising the amino acid sequence of SEQ ID NO: 721. In some embodiments comprising a first half-life extension domain and a second half-life extension domain, the first half-life extension domain comprises an Fc domain or fragment thereof comprising the amino acid sequence of SEQ ID NO: 721, and the second half-life extension domain comprises an Fc domain or fragment thereof comprising the amino acid sequence of SEQ ID NO: 772. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 721, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 772. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 772, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 721.

In some embodiments comprising a first half-life extension domain and a second half-life extension domain, the first half-life extension domain comprises an Fc domain or fragment thereof comprising the amino acid sequence of SEQ ID NO: 156, and the second half-life extension domain comprises an Fc domain or fragment thereof comprising the amino acid sequence of SEQ ID NO: 156. In some embodiments comprising a first half-life extension domain and a second half-life extension domain, the first half-life extension domain comprises an Fc domain or fragment thereof comprising the amino acid sequence of SEQ ID NO: 156, and the second half-life extension domain comprises an Fc domain or fragment thereof comprising the amino acid sequence of SEQ ID NO: 156. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 156.

In some embodiments comprising a first half-life extension domain and a second half-life extension domain, the first half-life extension domain comprises an Fc domain or fragment thereof comprising the amino acid sequence of SEQ ID NO: 157, and the second half-life extension domain comprises an Fc domain or fragment thereof comprising the amino acid sequence of SEQ ID NO: 158. In some embodiments comprising a first half-life extension domain and a second half-life extension domain, the first half-life extension domain comprises an Fc domain or fragment thereof comprising the amino acid sequence of SEQ ID NO: 158, and the second half-life extension domain comprises an Fc domain or fragment thereof comprising the amino acid sequence of SEQ ID NO: 157. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 157, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 158. In some embodiments comprising a first half-life extension domain and a second half-life extension domain, the first half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 158, and the second half-life extension domain comprises an Fc domain or fragment thereof comprising an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 157.

In some embodiments, the Fc domain or fragment thereof comprises the amino acid sequence of SEQ ID NO: 168. In some embodiments, the Fc domain or fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 168. In some embodiments, the Fc domain or fragment thereof comprises the amino acid sequence of SEQ ID NO: 169. In some embodiments, the Fc domain or fragment thereof comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 169.

In some embodiments, a half-life extension domain comprises an amino acid sequence produced by introducing one or more modifications to the amino acid sequence of the half-life extension domain, such as by introducing one or more amino acid substitutions, additions, or deletions to the amino acid sequence of any one of SEQ ID NOs: 154-158, 168-170, 265, 616, 619, 622, 625, 721,772-774, 793, and 796, or to any one of the amino acid sequences of the half-life extension domain described herein. The one or more modifications can be any modifications or alterations described herein, including, in some embodiments, any modifications or alterations disclosed herein that promote heterodimerization of polypeptide chains and/or suppresses homodimerization of polypeptide chains, alter effector function, or enhance effector function.

In some embodiments, the half-life extension domain comprises a heavy chain polypeptide that comprises one or more amino acid substitutions altering effector function. In some embodiments, the half-life extension domain is an IgG1 heavy chain polypeptide and comprises the amino substitution(s): N297A, N297G, or N297Q; L234A and L235A; C220S, C226S, C229S, and P238S; C226S, C229S, E233P, L234V, and L235A; L234F, L235E, and P331S; S267E and L328F; D265A; and/or L234A, L235A, and P329G, numbered according to the Kabat EU numbering system. In some embodiments, the half-life extension domain is an IgG1 heavy chain polypeptide and comprises one or more amino acid substitutions selected from the group consisting of N297A, N297G, N297Q, L234A, L235A, C220S, C226S, C229S, P238S, E233P, L234V, L234F, L235E, P331S, S267E, L328F, D265A, and P329G, numbered according to the Kabat EU numbering system. In some embodiments, the half-life extension domain is an IgG2 heavy chain polypeptide and comprises the amino substitution(s): V234A and G237A; H268Q, V309L, A330S, and A331S; or V234A, G237A, P238S, H268A, V309L, and A330S, numbered according to the Kabat EU numbering system. In some embodiments, the half-life extension domain is an IgG2 heavy chain polypeptide and comprises one or more amino acid substitutions selected from the group consisting of V234A, G237A, H268Q, V309L, A330S, A331S, P238S, H268A, and V309L, numbered according to the Kabat EU numbering system. In some embodiments, the half-life extension domain is an IgG4 heavy chain polypeptide and comprises the amino substitution(s): L235A, G237A, and E318A; S228P, L234A, and L235A; H268Q, V309L, A330S, and P331S; and/or S228P and L235A, numbered according to the Kabat EU numbering system. In some embodiments, the half-life extension domain is an IgG2 heavy chain polypeptide and comprises one or more amino acid substitutions selected from the group consisting of L235A, G237A, E318A, S228P, L234A, H268Q, V309L, A330S, and P331S, numbered according to the Kabat EU numbering system.

In some embodiments, the half-life extension domain comprises a heavy chain polypeptide that comprises one or more amino acid substitutions enhancing effector function. In some embodiments, the half-life extension domain is an IgG1 heavy chain polypeptide and comprises the amino acid substitution(s): S298A, E333A, and K334A; S239D and I332E; S239D, A330L, and I332E; P247I and A339D or A339Q; D280H and K290S; D280H, K290S, and either S298D or S298V; F243L, R292P, and Y300L; F243L, R292P, Y300L, and P396L; F243L, R292P, Y300L, V305I, and P396L; G236A, S239D, and I332E; K326A and E333A; K326W and E333S; K290E, S298G, and T299A; K290E, S298G, T299A, and K326E; K290N, S298G, and T299A; K290N, S298G, T299A, and K326E; K334V; L235S, S239D, and K334V; K334V and Q331M, S239D, F243V, E294L, or S298T; E233L, Q311M, and K334V; L234I, Q311M, and K334V; K334V and S298A, A330M, or A330F; K334V, Q311M, and either A330M or A330F; K334V, S298T, and either A330M or A330F; K334V, S239D, and either A330M or S298T; L234Y, Y296W, and K290Y, F243V, or E294L; Y296W and either L234Y or K290Y; S239D, A330S, and I332E, V264I; F243L and V264I; L328M; I332E; L328M and I332E; V264I and I332E; S239E and I332E; S239Q and I332E; S239E; A330Y; I332D; L328I and I332E; L328Q and I332E; V264T; V240I; V266I; S239D; S239D and I332D; S239D and I332N; S239D and I332Q; S239E and I332D; S239E and I332N; S239E and I332Q; S239N and I332D; S239N and I332E; S239Q and I332D; A330Y and I332E; V264I, A330Y, and I332E; A330L and I332E; V264I, A330L, and I332E; L234E, L234Y, or L234I; L235D, L235S, L235Y, or L235I; S239T; V240M; V264Y; A330I; N325T; I332E and L328D, L328V, L328T, or L328I; V264I, I332E, and either S239E or S239Q; S239E, V264I, A330Y, and I332E; A330Y, I332E, and either S239D or S239N; A330L, I332E, and either S239D or S239N; V264I, S298A, and I332E; S298A, I332E, and either S239D or S239N; S239D, V264I, and I332E; S239D, V264I, S298A, and I332E; S239D, V264I, A330L, and I332E; S239D, I332E, and A330I; P230A; P230A, E233D, and I332E; E272Y; K274T, K274E, K274R, K274L, or K274Y; F275W; N276L; Y278T; V302I; E318R; S324D, S324I or S324V; K326I or K326T; T335D, T335R, or T335Y; V240I and V266I; S239D, A330Y, I332E, and L234I; S239D, A330Y, I332E, and L235D; S239D, A330Y, I332E, and V240I; S239D, A330Y, I332E, and V264T; and/or S239D, A330Y, I332E, and either K326E or K326T, numbered according to the Kabat EU numbering system. In some embodiments, the half-life extension domain is an IgG1 heavy chain polypeptide and comprises one or more amino acid substitution(s) selected from the group consisting of: P230A, E233D, L234E, L234Y, L234I, L235D, L235S, L235Y, L235I, S239D, S239E, S239N, S239Q, S239T, V240I, V240M, F243L, V264I, V264T, V264Y, V266I, E272Y, K274T, K274E, K274R, K274L, K274Y, F275W, N276L, Y278T, V302I, E318R, S324D, S324I, S324V, N325T, K326I, K326T, L328M, L328I, L328Q, L328D, L328V, L328T, A330Y, A330L, A330I, I332D, I332E, I332N, I332Q, T335D, T335R, and T335Y.

In some embodiments, the half-life extension domain comprises an Fc domain or fragment thereof that comprises one or more amino acid substitutions altering effector function. In some embodiments, the half-life extension domain is an IgG1 Fc domain or fragment thereof and comprises the amino substitution(s): N297A, N297G, or N297Q; L234A and L235A; C220S, C226S, C229S, and P238S; C226S, C229S, E233P, L234V, and L235A; L234F, L235E, and P331S; S267E and L328F; D265A; and/or L234A, L235A, and P329G, numbered according to the Kabat EU numbering system. In some embodiments, the half-life extension domain is an IgG1 Fc domain or fragment thereof and comprises one or more amino acid substitutions selected from the group consisting of N297A, N297G, N297Q, L234A, L235A, C220S, C226S, C229S, P238S, E233P, L234V, L234F, L235E, P331S, S267E, L328F, D265A, and P329G, numbered according to the Kabat EU numbering system. In some embodiments, the half-life extension domain is an IgG2 Fc domain or fragment thereof and comprises the amino substitution(s): V234A and G237A; H268Q, V309L, A330S, and A331S; and/or V234A, G237A, P238S, H268A, V309L, and A330S, numbered according to the Kabat EU numbering system. In some embodiments, the half-life extension domain is an IgG2 Fc domain or fragment thereof and comprises one or more amino acid substitutions selected from the group consisting of V234A, G237A, H268Q, V309L, A330S, A331S, P238S, H268A, and V309L, numbered according to the Kabat EU numbering system. In some embodiments, the half-life extension domain is an IgG4 Fc domain or fragment thereof and comprises the amino substitution(s): L235A, G237A, and E318A; S228P, L234A, and L235A; H268Q, V309L, A330S, and P331S; and/or S228P and L235A, numbered according to the Kabat EU numbering system. In some embodiments, the half-life extension domain is an IgG2 Fc domain or fragment thereof and comprises one or more amino acid substitutions selected from the group consisting of L235A, G237A, E318A, S228P, L234A, H268Q, V309L, A330S, and P331S, numbered according to the Kabat EU numbering system.

In some embodiments, the half-life extension domain comprises Fc domain or fragment thereof that comprises one or more amino acid substitutions enhancing effector function. In some embodiments, the half-life extension domain is an IgG1 Fc domain or fragment thereof and comprises the amino acid substitution(s): S298A, E333A, and K334A; S239D and I332E; S239D, A330L, and I332E; P247I and A339D or A339Q; D280H and K290S; D280H, K290S, and either S298D or S298V; F243L, R292P, and Y300L; F243L, R292P, Y300L, and P396L; F243L, R292P, Y300L, V305I, and P396L; G236A, S239D, and I332E; K326A and E333A; K326W and E333S; K290E, S298G, and T299A; K290E, S298G, T299A, and K326E; K290N, S298G, and T299A; K290N, S298G, T299A, and K326E; K334V; L235S, S239D, and K334V; K334V and Q331M, S239D, F243V, E294L, or S298T; E233L, Q311M, and K334V; L234I, Q311M, and K334V; K334V and S298T, A330M, or A330F; K334V, Q311M, and either A330M or A330F; K334V, S298T, and either A330M or A330F; K334V, S239D, and either A330M or S298T; L234Y, Y296W, and K290Y, F243V, or E294L; Y296W and either L234Y or K290Y; S239D, A330S, and I332E, V264I; F243L and V264I; L328M; I332E; L328M and I332E; V264I and I332E; S239E and I332E; S239Q and I332E; S239E; A330Y; I332D; L328I and I332E; L328Q and I332E; V264T; V240I; V266I; S239D; S239D and I332D; S239D and I332N; S239D and I332Q; S239E and I332D; S239E and I332N; S239E and I332Q; S239N and I332D; S239N and I332E; S239Q and I332D; A330Y and I332E; V264I, A330Y, and I332E; A330L and I332E; V264I, A330L, and I332E; L234E, L234Y, or L234I; L235D, L235S, L235Y, or L235I; S239T; V240M; V264Y; A330I; N325T; I332E and L328D; L328V, L328T, or L328I; V264I, I332E, and either S239E or S239Q; S239E, V264I, A330Y, and I332E; A330Y, I332E, and either S239D or S239N; A330L, I332E, and either S239D or S239N; V264I, S298A, and I332E; S298A, I332E, and either S239D or S239N; S239D, V264I, and I332E; S239D, V264I, S298A, and I332E; S239D, V264I, A330L, and I332E; S239D, I332E, and A330I; P230A; P230A, E233D, and I332E; E272Y; K274T, K274E, K274R, K274L, or K274Y; F275W; N276L; Y278T; V302I; E318R; S324D, S324I or S324V; K326I or K326T; T335D, T335R, or T335Y; V240I and V266I; S239D, A330Y, I332E, and L234I; S239D, A330Y, I332E, and L235D; S239D, A330Y, I332E, and V240I; S239D, A330Y, I332E, and V264T; and/or S239D, A330Y, I332E, and either K326E or K326T, numbered according to the Kabat EU numbering system. In some embodiments, the half-life extension domain is an IgG1 Fc domain or fragment thereof and comprises one or more amino acid substitution(s) selected from the group consisting of: P230A, E233D, L234E, L234Y, L234I, L235D, L235S, L235Y, L235I, S239D, S239E, S239N, S239Q, S239T, V240I, V240M, F243L, V264I, V264T, V264Y, V266I, E272Y, K274T, K274E, K274R, K274L, K274Y, F275W, N276L, Y278T, V302I, E318R, S324D, S324I, S324V, N325T, K326I, K326T, L328M, L328I, L328Q, L328D, L328V, L328T, A330Y, A330L, A330I, I332D, I332E, I332N, I332Q, T335D, T335R, and T335Y.

In some embodiments, the half-life extension domain comprises one or more amino acid substitution(s) that enhance binding of the half-life extension domain to FcRn. In some embodiments, the one or more amino acid substitution(s) increase binding affinity of an Fc-containing polypeptide (e.g., a heavy chain polypeptide or an Fc domain or fragment thereof) to FcRn at acidic pH. In some embodiments, the half-life extension domain comprises one or more amino acid substitution(s) selected from the group consisting of M428L; T250Q and M428L; M252Y, S254T, and T256E; P257I and N434H; D376V and N434H; P257I and Q311I; N434A; N434W; M428L and N434S; V259I and V308F; M252Y, S254T, and T256E; V259I, V308F and M428L; T307Q and N434A; T307Q and N434S; T307Q, E380A, and N434A; V308P and N434A; N434H; and V308P.

In some embodiments, the masked cytokine is a dimer is that is formed by the half-life extension domain of one copy of the masked cytokine forming a disulfide bond with the corresponding half-life extension domain of a second copy of the masked cytokine.

2. Albumin

Albumin (also referred to herein as human serum albumin (HSA)) is a natural carrier protein that has an extended serum half-life of approximately three weeks due to its size and its susceptibility to FcRn-mediated recycling, which prevents intracellular degradation. Thus, linking a masked cytokine to albumin can greatly extend the half-life of the masked cytokine. This approach has been taken to extend the plasma half-life of therapeutically beneficial proteins. See, e.g., WO 2001/079271A1 and WO 2003/59934A2, the contents of which are herein incorporated by reference. HSA in its mature form is a polypeptide of 585 amino acids as shown in SEQ ID NO: 171.

In some embodiments, the masked cytokine comprises a half-life extension domain that comprises an albumin polypeptide or a fragment or variant thereof (hereinafter referred to as "albumin" or "albumin polypeptide"). As used herein, the terms "albumin" and "albumin polypeptide" includes fragments of albumin as well as variants of albumin. The albumin polypeptide comprises an amino-terminus and a carboxy-terminus. The albumin polypeptide can be any albumin polypeptide, including any fragment or variant thereof, such as any albumin polypeptide described in WO 2001/079271A1; WO 2003/59934A2; US20160152686A1; WO 2012/059486; WO 2011/124718; US20070048282, the contents of which are herein incorporated by reference. In some embodiments, the albumin polypeptide is HSA.

In some embodiments of the masked cytokine, the half-life extension domain comprises an albumin polypeptide. In some embodiments, the masked cytokine comprises more than one albumin polypeptide, each of which can be any of the albumin polypeptides described herein. In some embodiments, the masked cytokine comprises a first half-life extension domain and a second half-life extension domain, each of which comprises an albumin polypeptide. It is understood that reference to "an albumin polypeptide" or "the albumin polypeptide" can refer to the albumin polypeptide of the half-life extension domain in a masked cytokine comprising a single half-life extension domain, or it can refer to the albumin polypeptide of the first half-life extension domain in a masked cytokine comprising a first half-life extension domain and a second half-life extension domain, or it can refer to the albumin polypeptide of the second half-life extension domain in a masked cytokine comprising a first half-life extension domain and a second half-life extension domain, or it can refer to the albumin polypeptide of the first half-life extension domain and the albumin polypeptide of the second half-life extension domain in a masked cytokine comprising a first half-life extension domain and a second half-life extension domain.

In some embodiments, the albumin polypeptide is linked to a masking moiety. In some embodiments, a masking moiety is linked to the amino-terminus or the carboxy-terminus of the albumin polypeptide. In some embodiments, the albumin polypeptide is linked to a masking moiety via a linker. In some embodiments, a linker is linked to the amino-terminus or the carboxy-terminus of the albumin polypeptide. In some embodiments, an N-terminal spacer domain or a C-terminal spacer domain of the linker is linked to the amino-terminus or the carboxy-terminus of the albumin polypeptide. In some embodiments, a cleavable peptide of the linker is linked to the amino-terminus or the carboxy-terminus of the albumin polypeptide. In some embodiments, the albumin polypeptide is linked to a cytokine or functional fragment thereof. In some embodiments, a cytokine or functional fragment thereof is linked to the amino-terminus or the carboxy-terminus of the albumin polypeptide. In some embodiments, the albumin polypeptide is linked to a cytokine or functional fragment thereof via a linker. In some embodiments, a linker is linked to the amino-terminus or the carboxy-terminus of the albumin polypeptide.

In some embodiments, the albumin polypeptide comprises the amino acid sequence of SEQ ID NO: 171. In some embodiments, the albumin polypeptide comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 171.

In some embodiments, the albumin polypeptide is a variant of albumin consisting of a fragment of HSA (optionally with one or more amino acid modifications). In some embodiments, the fragment of HSA is a fragment of wild-type HSA. In some embodiments, the albumin polypeptide comprises HSA domain 1 (amino acid residues 1-194 of SEQ ID NO: 171), HSA domain 2 (amino acid residues 195-387 of SEQ ID NO: 171), HSA domain 3 (amino acid residues 388-585), HSA domains 1 and 2, HSA domains 2 and 3, HSA domains 1 and 3, or two copies of HSA domain 3 In some embodiments, the albumin polypeptide consists of HSA domain 1 (amino acid residues 1-194 of SEQ ID NO: 171), HSA domain 2 (amino acid residues 195-387 of SEQ ID NO: 171), HSA domain 3 (amino acid residues 388-585), HSA domains 1 and 2, HSA domains 2 and 3, HSA domains 1 and 3, or two copies of HSA domain 3.

In some embodiments, the albumin polypeptide comprises amino acid residues 1-194 of SEQ ID NO: 171. In some embodiments, the albumin polypeptide comprises amino acid residues 195-387 of SEQ ID NO: 171. In some embodiments, the albumin polypeptide comprises amino acid residues 388-585 of SEQ ID NO: 171. In some embodiments, the albumin polypeptide comprises amino acid residues 1-387 of SEQ ID NO: 171. In some embodiments, the albumin polypeptide comprises amino acid residues 195-585 of SEQ ID NO: 171. In some embodiments, the albumin polypeptide comprises amino acid residues 1-105 of SEQ ID NO: 171. In some embodiments, the albumin polypeptide comprises amino acid residues 120-194 of SEQ ID NO: 171. In some embodiments, the albumin polypeptide comprises amino acid residues 195-291 of SEQ ID NO: 171. In some embodiments, the albumin polypeptide comprises amino acid residues 316-387 of SEQ ID NO: 171. In some embodiments, the albumin polypeptide comprises amino acid residues 388-491 of SEQ ID NO: 171. In some embodiments, the albumin polypeptide comprises amino acid residues 512-585 of SEQ ID NO: 171. In some embodiments, the albumin polypeptide comprises amino acid residues 1-194 and 388-585 of SEQ ID NO: 171. In some embodiments, the albumin polypeptide comprises two copies of amino acid residues 388-585 of SEQ ID NO: 171.

In some embodiments, the albumin polypeptide comprises an amino acid sequence produced by one or more amino acid modifications to the amino acid sequence of any of the embodiments of the albumin polypeptide described herein. In some embodiments, the albumin polypeptide comprises an amino acid sequence comprising one or more amino acid modifications that increase the half-life of the albumin polypeptide in serum. Exemplary amino acid modifications that increase the half-life of the albumin polypeptide in serum include amino acid substitutions made to E492, N503, D550, and/or K573 of HSA. In some embodiments, the albumin polypeptide comprises one or more amino acid modifications that increase the affinity of the albumin polypeptide for the FcRn receptor. Exemplary amino acid modifications that increase the affinity of the albumin polypeptide for the FcRn receptor include V418M, T420A, E505G, and V547A. In some embodiments, the albumin polypeptide comprises an amino acid sequence produced by one or more amino acid modifications to the amino acid sequence of SEQ ID NO: 171. In some embodiments, the albumin polypeptide comprises an amino acid sequence produced by one or more amino acid modifications to the amino acid sequence of SEQ ID NO: 171. In some embodiments, the one or more amino acid modifications to the amino acid sequence of any of the albumin polypeptides described herein is/are selected from the group consisting of Q417A, H440Q, H464Q, A490D, E492G/T/P/H, V493P/L, D494N/Q/A/E/P, E495Q/A, T496A, P499A, K500E/G/D/A/S/C/P/H/F/N/W/T/M/Y/V/Q/L/I/R, E501A/P/Q, N503K/D/H, A504E, E505K/D, T506F/S, H510Q, H535Q, K536A, P537A, K538A/H, T540S, K541A/D/G/N/E, E542P/D, D550N, K573Y/W/P/H/F/V/I/T/N/S/G/M/C/A/E/Q/R/L/D, K574N, Q580K, L575F, A577T/E, A578R/S, S579C/T, Q580K, A581D, A582T, and G584A. In some embodiments, the one or more amino acid modifications to the amino acid sequence of any of the albumin polypeptides described herein is/are selected from the group consisting of V418M, T420A, E505G, and V547A.

3. Binding Proteins

Additional strategies for extending the half-life of masked cytokines in serum include linking the masked cytokine to certain binding proteins, such as albumin-binding proteins or IgG-binding proteins. The binding proteins can be any protein that binds to a serum protein having a prolonged half-life, such as albumin or IgG. Albumin and IgG are polypeptides that are known to have long half-lives in serum. Since albumin-binding proteins bind to, or otherwise associate with, albumin in serum, masked cytokines that are linked to an albumin-binding protein can exhibit an extended half-life in serum. Likewise, since IgG-binding proteins bind, or otherwise associate with, IgG in serum, masked cytokines that are linked to an IgG-binding protein can exhibit an extended half-life in serum.

Albumin-binding proteins and methods by which they are linked to proteins of interest are described, for example, in WO 1991/01743, WO 2001/45746, WO 2002/076489, WO 2004/041865, or US20070269422A1, the contents of which are herein incorporated by reference.

In some embodiments, the half-life extension domain comprises an albumin-binding protein. The albumin-binding protein can be any of the albumin-binding proteins described, for instance, in WO1991/01743, WO2001/45746, WO2002/076489, WO2004/041865, US20070269422A1; US20160152686A1; Dennis et al. (2002), JBC 277(38): 35035-35043.

In some embodiments of the masked cytokine, the half-life extension domain comprises an albumin-binding protein. In some embodiments, the masked cytokine comprises more than one albumin-binding protein, each of which can be any of the albumin-binding proteins described herein. In some embodiments, the masked cytokine comprises a first half-life extension domain and a second half-life extension domain, each of which comprises an albumin-binding protein. It is understood that reference to "an albumin-binding protein" or "the albumin-binding protein" can refer to the albumin-binding protein of the half-life extension domain in a masked cytokine comprising a single half-life extension domain, or it can refer to the albumin-binding protein of the first half-life extension domain in a masked cytokine comprising a first half-life extension domain and a second half-life extension domain, or it can refer to the albumin-binding protein of the second half-life extension domain in a masked cytokine comprising a first half-life extension domain and a second half-life extension domain, or it can refer to the albumin-binding protein of the first half-life extension domain and the albumin-binding protein of the second half-life extension domain in a masked cytokine comprising a first half-life extension domain and a second half-life extension domain.

In some embodiments, the albumin-binding protein comprises an albumin-binding domain (ABD) of Streptococcal protein G (SPG). See, e.g., Nygren et al. J. Mol. Recogn. (1988) 1(2): 69-74. In some embodiments, the albumin-binding protein comprises an ABD of SPG strain G148. In some embodiments, the albumin-binding protein comprises the C-terminal albumin-binding domain 3 (ABD3) of SPG strain G148. See, e.g., Nilvebrant and Hober (2013), Comput. Struct. Biotechnol. J., 6: e201303009. In some embodiments, the albumin-binding protein comprises the amino acid sequence of SEQ ID NO: 172. In some embodiments, the albumin-binding protein comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 172.

In some embodiments, the albumin-binding protein comprises a natural or synthetic peptide. In some embodiments, the albumin-binding protein comprises the amino acid sequence of SEQ ID NO: 173 or 174. In some embodiments, the albumin-binding protein comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of SEQ ID NO: 173 or 174.

In some embodiments, an albumin-binding domain comprises an amino acid sequence produced by introducing one or more modifications to the amino acid sequence of the albumin-binding domain, such as by introducing one or more amino acid substitutions, additions, or deletions to the amino acid sequence of any one of SEQ ID NOs: 172-174.

In some embodiments, the albumin-binding protein is a single-domain antibody or fragment thereof, such as a Nanobody, that binds to or otherwise associates with albumin. See, e.g., WO 2004041865A2 and US20070269422A1, the contents of which are herein incorporated by reference. In some embodiments, the single-domain antibody or fragment thereof comprises an amino acid sequence selected from the group consisting of SEQ ID NOs: 252-259. In some embodiments, the single-domain antibody or fragment thereof comprises an amino acid sequence having about or at least about 85%, 86%, 87%, 88%, 89%, 90%, 91%, 92%, 93%, 94%, 95%, 96%, 97%, 98%, or 99% sequence identity to an amino acid sequence selected from the group consisting of SEQ ID NOs: 252-259.

In some embodiments, the albumin-binding protein is linked to a masking moiety. In some embodiments, a masking moiety is linked to the amino-terminus or the carboxy-terminus of the albumin-binding protein. In some embodiments, the albumin-binding protein is linked to a masking moiety via a linker. In some embodiments, a linker is linked to the amino-terminus or the carboxy-terminus of the albumin-binding protein. In some embodiments, an N-terminal spacer domain or a C-terminal spacer domain of the linker is linked to the amino-terminus or the carboxy-terminus of the albumin-binding domain. In some embodiments, a cleavable peptide of the linker is linked to the amino-terminus or the carboxy-terminus of the albumin-binding domain. In some embodiments, the albumin-binding protein is linked to a cytokine or functional fragment thereof. In some embodiments, a cytokine or functional fragment thereof is linked to the amino-terminus or the carboxy-terminus of the albumin-binding protein. In some embodiments, the albumin-binding protein is linked to a cytokine or functional fragment thereof via a linker. In some embodiments, a linker is linked to the amino-terminus or the carboxy-terminus of the albumin-binding protein.

Another example of a binding protein is an IgG-binding protein. IgG-binding proteins have been reported. For an overview of IgG-binding proteins, including specific IgG-binding proteins and their applications, see, e.g., Choe et al. (2016) Materials 9(12): 994, the contents of which are herein incorporated by reference.

In some embodiments of the masked cytokine, the half-life extension domain comprises an IgG-binding protein. In some embodiments, the masked cytokine comprises more than one IgG-binding protein, each of which can be any of the IgG-binding proteins described herein. In some embodiments, the masked cytokine comprises a first half-life extension domain and a second half-life extension domain, each of which comprises an IgG-binding protein. It is understood that reference to "an IgG-binding protein" or "the IgG-binding protein" can refer to the IgG-binding protein of the half-life extension domain in a masked cytokine comprising a single half-life extension domain, or it can refer to the IgG-binding protein of the first half-life extension domain in a masked cytokine comprising a first half-life extension domain and a second half-life extension domain, or it can refer to the IgG-binding protein of the second half-life extension domain in a masked cytokine comprising a first half-life extension domain and a second half-life extension domain, or it can refer to the IgG-binding protein of the first half-life extension domain and the IgG-binding protein of the second half-life extension domain in a masked cytokine comprising a first half-life extension domain and a second half-life extension domain.

In some embodiments, the half-life extension domain comprises an IgG-binding protein. The IgG-binding protein can be any IgG-binding protein. The IgG-binding protein can be any IgG-binding protein described, e.g., in Choe et al. (2016) Materials 9(12): 994; US20140046037A1. For instance, a variety of bacterial proteins have been shown to bind to mammalian IgGs, including Protein A, G, L, and Z, and fusion proteins of Protein LG and LA. See, e.g., Choe et al. (2016) Materials 9(12): 994. In some embodiments, the IgG-binding protein is a *Staphylococcal* protein A (SpA) protein from the bacterium *Staphylococcus aureus*, or fragment or variant thereof. In some embodiments, the IgG-binding domain is an IgG-binding domain of SpA, or a fragment or variant thereof. In some embodiments, the IgG-binding domain is one or more of the SpA IgG-binding domain E, D, A, B, C, and Z, or fragments or variants thereof.

In some embodiments, the IgG-binding domain comprises an amino acid sequence selected from the group consisting of SEQ ID NOs: 175-186. In some embodiments, the IgG-binding protein comprises an amino acid sequence having about or at least about 85%, 86%, 87%, 88%, 89%, 90%, 91%, 92%, 93%, 94%, 95%, 96%, 97%, 98%, or 99% sequence identity to the amino acid sequence of any one of SEQ ID NOs: 175-186.

In some embodiments, an IgG-binding domain comprises an amino acid sequence produced by introducing one or more modifications to the amino acid sequence of the IgG-binding domain, such as by introducing one or more amino acid substitutions, additions, or deletions to the amino acid sequence of any one of SEQ ID NOs: 175-186.

In some embodiments, the IgG-binding protein is linked to a masking moiety. In some embodiments, a masking moiety is linked to the amino-terminus or the carboxy-terminus of the IgG-binding protein. In some embodiments, the IgG-binding protein is linked to a masking moiety via a linker. In some embodiments, a linker is linked to the amino-terminus or the carboxy-terminus of the IgG-binding protein. In some embodiments, an N-terminal spacer domain or a C-terminal spacer domain of the linker is linked to the amino-terminus or the carboxy-terminus of the IgG-binding domain. In some embodiments, a cleavable peptide of the linker is linked to the amino-terminus or the carboxy-terminus of the IgG-binding domain. In some embodiments, the IgG-binding protein is linked to a cytokine or functional fragment thereof. In some embodiments, a cytokine or functional fragment thereof is linked to the amino-terminus or the carboxy-terminus of the IgG-binding protein. In some embodiments, the IgG-binding protein is linked to a cytokine or functional fragment thereof via a linker. In some embodiments, a linker is linked to the amino-terminus or the carboxy-terminus of the IgG-binding protein.

4. Antibody Derivatives

The masked cytokines described herein may alternatively be linked to various antibody derivatives including, but not limited to, an scFv, an scFc, a dual-variable domain (DVD), and antibody derivatives based on the CrossMab approach. See, e.g., Klein et al. (2012), MAbs, 4(6): 653-663; US20070071675A1. The antibody derivatives include antibody derivatives engineered as bispecific antibodies or fragments thereof. As such, in some embodiments, a half-life extension domain can comprise any antibody derivative, variant, or fusion product thereof including, but not limited to an scFv, an scFc, a dual-variable domain (DVD), antibody derivatives based on the CrossMab approach, and bispecific antibodies or fragments thereof.

5. Polyamino Acid Sequences

An additional strategy for extending the half-life of masked cytokines in serum is by linking the masked cytokine to a polyamino acid sequence. As such, in some embodiments, the half-life extension domain comprises a polyamino acid sequence. The polyamino acid sequence can be any poly amino acid sequence capable of extending the half-life of the masked cytokine in serum when it is linked to the masked cytokine. Examples of polyamino acid sequences include PAS polypeptides and XTEN polypeptides.

In some embodiments, the polyamino acid sequence is a polypeptide chain comprising the small amino acid residues proline, alanine, and, optionally, serine (PAS polypeptide). PAS sequences are hydrophilic and uncharged polymers that have biophysical properties similar to polyethylene glycol (PEG), which is commonly linked to therapeutic proteins as a strategy for extending the therapeutic protein's half-life in vivo. See, e.g., Schlapschy et al. (2013) Protein Eng. Des. Sel., 26(8): 489-501; WO2008155134A1; WO2011144756A1; WO2016130451A1, the contents of which are herein incorporated by reference. Attachment of a PAS polypeptide to a therapeutic protein has been observed to increase stability in vivo and/or in vitro compared to the therapeutic protein in its native state without the PAS polypeptide attached. In some embodiments, the PAS polypeptide assumes a random coil conformation. In some embodiments, the PAS polypeptide forms a random coil conformation domain.

In some embodiments, the half-life extension domain comprises a PAS polypeptide that comprises the amino acid residues proline and alanine. In some embodiments, the half-life extension domain comprises a PAS polypeptide that comprises the amino acid residues proline, alanine, and serine. In some embodiments, the PAS polypeptide comprises at least 25 amino acid residues, at least 50 amino acid residues, at least 100 amino acid residues, at least 150 amino acid residues, at least 200 amino acid residues, at least 250 amino acid residues, at least 300 amino acid residues, at least 400 amino acid residues, at least 500 amino acid residues, at least 600 amino acid residues, at least 700 amino acid residues, at least 800 amino acid residues, at least 900 amino acid residues, at least 1000 amino acid residues, at least 1100 amino acid residues, at least 1200 amino acid residues, at least 1300 amino acid residues, at least 1500 amino acid residues, at least 2000 amino acid residues, at least 2500 amino acid residues, or at least 3000 amino acid residues. In some embodiments, the PAS polypeptide comprises at least 25 amino acid residues, at least 50 amino acid residues, at least 100 amino acid residues, at least 150 amino acid residues, at least 200 amino acid residues, at least 250 amino acid residues, at least 300 amino acid residues, at least 400 amino acid residues, at least 500 amino acid residues, at least 600 amino acid residues, at least 700 amino acid residues, at least 800 amino acid residues, at least 900 amino acid residues, at least 1000 amino acid residues, at least 1100 amino acid residues, at least 1200 amino acid residues, at least 1300 amino acid residues, at least 1500 amino acid residues, at least 2000 amino acid residues, at least 2500 amino acid residues, or at least 3000 amino acid residues, wherein each amino acid residue is either a proline or an alanine. In some embodiments, the PAS polypeptide comprises at least 25 amino acid residues, at least 50 amino acid residues, at least 100 amino acid residues, at least 150 amino acid residues, at least 200 amino acid residues, at least 250 amino acid residues, at least 300 amino acid residues, at least 400 amino acid residues, at least 500 amino acid residues, at least 600 amino acid residues, at least 700 amino acid residues, at least 800 amino acid residues, at least 900 amino acid residues, at least 1000 amino acid residues, at least 1100 amino acid residues, at least 1200 amino acid residues, at least 1300 amino acid residues, at least 1500 amino acid residues, at least 2000 amino acid residues, at least 2500 amino acid residues, or at least 3000 amino acid residues, wherein each amino acid residue is an amino acid selected from the group consisting of a proline, an alanine, and a serine.

In some embodiments, the polyamino acid sequence is an extended recombinant polypeptide (XTEN polypeptide). XTEN polypeptides are polypeptides with non-naturally occurring, substantially non-repetitive sequences having a low degree or no secondary or tertiary structure under physiologic conditions. XTEN polypeptides typically have from about 36 to about 3000 amino acid residues, of which the majority or the entirety are small hydrophilic amino acids (e.g., arginine, lysine, threonine, alanine, asparagine, glutamine, aspartate, glutamate, serine, and glycine). The physiochemical properties, as well as the unstructured characteristic, of XTEN polypeptides is result, in part, from the overall amino acid composition that is disproportionately limited to 4-6 types of hydrophilic amino acids, the linking of the amino acids in a non-repetitive design, and the length of the XTEN polypeptide. The attachment of an XTEN polypeptide to a therapeutic protein has been observed to improve solubility and stability, and to enhance the half-life of the therapeutic protein. See, e.g., Podust et al. (2016) J. Controlled Release, 240: 52-66; WO2013130683A2, the contents of which are herein incorporated by reference.

In some embodiments, the half-life extension domain comprises an XTEN polypeptide that comprises an amino acid sequence that is made up of four, five, or six types of amino acid residues selected from the group consisting of glycine (G), alanine (A), serine (S), threonine (T), glutamate (E) and proline (P).

In some embodiments, the XTEN polypeptide comprises an amino acid sequence of about 25 to about 500 amino acid residues, about 200 to about 1000 amino acid residues, about 500 to about 1500 amino acid residues, about 1000 to about 2000 amino acid residues, or about 1500 to about 3000 amino acid residues. In some embodiments, at least about 70%, 75%, 80%, or 85% of the amino acid sequence consists of non-overlapping sequence motifs. In some embodiments, each of the motifs has 5 to 100 amino acid residues, 5 to 50 amino acids residues, or 9 to 36 amino acid residues, and wherein at least 90%, at least 91%, at least 92%, at least 93%, at least 94%, at least 95%, at least 96%, at least 97%, at least 98%, at least 99%, or 100% of each of the motifs consists of four, five, or six types of amino acid residues selected from the group consisting of glycine (G), alanine (A), serine (S), threonine (T), glutamate (E) and proline (P), In some embodiments, the content of any one amino acid type in the full-length XTEN polypeptide does not exceed about 40%, about 35%, about 30%, about 25%, about 15%, about 10%, or about 8%.

In some embodiments, the XTEN polypeptide comprises an amino acid sequence of about 25 to about 500 amino acid residues, about 200 to about 1000 amino acid residues, about 500 to about 1500 amino acid residues, about 1000 to about 2000 amino acid residues, or about 1500 to about 3000 amino acid residues, wherein at least about 80% of the amino acid sequence consists of non-overlapping sequence motifs where each of the motifs has 9 to 36 amino acid residues and wherein at least 90%, at least 91%, at least 92%, at least 93%, at least 94%, at least 95%, at least 96%, at least 97%, at least 98%, at least 99%, or 100% of each of the motifs consists of four, five, or six types of amino acid residues selected from the group consisting of glycine (G), alanine (A), serine (S), threonine (T), glutamate (E) and proline (P), and wherein the content of any one amino acid type in the full-length XTEN polypeptide does not exceed about 40%, about 35%, about 30%, about 25%, about 15%, about 10%, or about 8%.

6. PEGylation and Glycosylation

Additional strategies for extending the half-life of the masked cytokines provided herein include PEGylation and the engineering of additional glycosylation sites. Each of these strategies is discussed in further detail below.

"PEGylation" refers to a process of covalent or non-covalent attachment or amalgamation of polyethylene glycol (PEG) polymer chains to molecules and macrostructures, such as a drug, therapeutic protein, polypeptide, antibody, antibody fragment, antibody derivative, or to any of the masked cytokines or components thereof provided herein (e.g., the half-life extension domain of a masked cytokine and/or the cytokine or functional fragment thereof of the masked cytokine). The benefits of PEGylation include, for example, (1) markedly improved circulating half-lives in vivo due to either evasion of renal clearance as a result of the polymer increasing the apparent size of the molecule to above the glomerular filtration limit, and/or through evasion of cellular clearance mechanisms, (2) reduced antigenicity and immunogenicity of the molecule to which PEG is attached, (3) improved pharmacokinetics, (4) improved solubility, (5) improved formulation and dosing options, (6) improved bioavailability via reduced losses at subcutaneous injection sites, (7) improved thermal and mechanical stability of the PEGylated molecule.

Methods for the pegylation of various molecules and macrostructures are well known in the art. See, e.g., US20140256636A1; Fee and Damodaran (2010) European Pharmaceutical Review, 15(1): 18-26; Chapman et al. (1999) Nature Biotechnol., 17: 780-783; Yang et al. (2003), Protein Eng., 16(10): 761-770; Chapman, Adv. Drug. Deliv. Rev. (2002), 54(4): 531-545, the contents of which are herein incorporated by reference.

In some embodiments, the masked cytokine of any of the embodiments herein is PEGylated. For instance, in some embodiments, this is accomplished by functionalizing PEG with group-specific reagents so that the conjugation of PEG to the protein (e.g., a half-life extension domain, or a cytokine or functional fragment thereof) can be targeted to specific side chain groups of the protein, such as amino, carboxyl, sulfhydryl, or guanidine groups. In some embodiments, cysteine (C) residues are introduced by amino acid substitution into the protein (e.g., a half-life extension domain, or a cytokine or functional fragment thereof) in a site-specific manner. The thiol groups of the newly introduced cysteine residues can then be targeted for PEGylation using malemide chemistry-based PEG reagents. The replacement of serine (S) or threonine (T) with cysteine has an advantage in that the net charge of the modified protein is not altered as a result of the PEGylation. As such, in some embodiments, a component of the masked cytokine, such as any of the cytokines or functional fragments thereof and/or any of the half-life extension domains, can be modified, or further modified, by introducing cysteine residues for PEGylation.

"Glycosylation" refers to the addition of saccharides or glycosyl groups to a polypeptide. Glycosylation of polypeptides is typically either N-linked or O-linked. N-linked refers to the attachment of a carbohydrate moiety to the side chain of an asparagine residue. The tripeptide sequences asparagine-X-serine (N-X-S) and asparagine-X-threonine (N-X-T), where X is any amino acid except proline (P), are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars (e.g., N-aceylgalactosamine, galactose, or xylose) to a hydroxyamino acid, most commonly serine or threonine, although 5-hydroxyproline or 5-hydroxylysine may also be used.

Naturally-occurring glycosylation has been shown to increase the molecular stability of proteins. See, e.g., Sola et al. (2007), Cell. Mol. Life Sci., 64(16): 2133-2152. It has also been shown that the engineering of additional glycosylation sites can stabilize a variety of protein therapeutics against most major physiochemical instabilities. See, e.g., Sola and Griebenow (2009), J. Pharm. Sci., 98(4): 1223-1245. Among the pharmaceutically relevant protein instabilities that have been shown to be improved by glycosylation are, for example, oxidation; cross-linking; pH-, chemical-, thermal-, and freezing-induced denaturation/unfolding; precipitation; kinetic activation; and aggregation. Id.

Addition of glycosylation sites to the masked cytokine is conveniently accomplished by altering the amino acid sequence such that one or more of the above-described tripeptide sequences (for N-linked glycosylation sites) is created in the amino acid sequence of the masked cytokine (e.g., in the amino acid sequence of the half-life extension domain and/or the cytokine or functional fragment thereof). The alteration may also be made by the addition to, or substitution of, one or more serine or threonine residues in the amino acid sequence of the masked cytokine (e.g., in the amino acid sequence of the half-life extension domain and/or the cytokine or functional fragment thereof) (for O-linked glycosylation sites).

In some embodiments, the masked cytokine of any of the embodiments herein is modified, or is further modified, by altering the amino acid sequence of the masked cytokine (e.g., the amino acid sequence of the half-life extension domain and/or the cytokine or functional fragment thereof) such that one or more additional N-X-S and/or N-X-T tripeptide sequence(s) is/are introduced into the amino acid sequence of the masked cytokine or component thereof (for the addition of one or more N-linked glycosylation sites). In some embodiments, the masked cytokine of any of the embodiments herein is modified, or is further modified, by altering the amino acid sequence of the masked cytokine or component thereof (e.g., the amino acid sequence of the half-life extension domain and/or the cytokine or functional fragment thereof) such that one or more additional serine or threonine residues is/are introduced into the amino acid sequence of the masked cytokine or component thereof (for the addition of one or more O-linked glycosylation sites). In some embodiments, the alteration of the amino acid sequence for the addition of one or more N-linked glycosylation sites and/or for the addition of one or more O-linked glycosylation sites is accomplished by the addition of one or more amino acids to the amino acid sequence of the masked cytokine or component thereof. In some embodiments, the alteration of the amino acid sequence for the addition of one or more N-linked glycosylation sites and/or for the addition of one or more O-linked glycosylation sites is accomplished by the substitution of one or more amino acids in the amino acid sequence of the masked cytokine or component thereof. In some embodiments, the alteration of the amino acid sequence for the addition of one or more N-linked glycosylation sites and/or for the addition of one or more O-linked glycosylation sites is accomplished by the addition of one or more amino acids to the amino acid sequence and by the substitution of one or more amino acids in the amino acid sequence of the masked cytokine or component thereof.

7. Heterodimerization Modifications

The half-life extension domains described herein may include one or more modifications that promote heterodimerization of two different half-life extension domains. In some embodiments comprising a first half-life extension domain and a second half-life extension domain, it is desirable to promote heterodimerization of the first and second half-life extension domains such that production of the masked cytokine in its correct heterodimeric form is produced efficiently. As such, one or more amino acid modifications can be made to the first half-life extension domain and one or more amino acid modifications can be made to the second half-life extension domain using any strategy available in the art, including any strategy as described in Klein et al. (2012), MAbs, 4(6): 653-663. Exemplary strategies and modifications are described in detail below.

a. Knobs-into-Holes Approach

One strategy for promoting heterodimerization of two different half-life extension domains is an approach termed the "knobs-into-holes."

In some embodiments, the masked cytokine comprises a first half-life extension domain and a second half-life extension domain, each of which comprises a CH3 domain. In some embodiments, the half-life extension domain comprising a CH3 domain is a heavy chain polypeptide or a fragment thereof (e.g., an Fc domain or fragment thereof). The CH3 domains of the two half-life extension domains can be altered by the "knobs-into-holes" technology, which is described in detail with several examples in, e.g., WO 1996/027011; Ridgway, J. B. et al., Protein Eng. (1996) 9(7): 617-621; Merchant, A. M., et al., Nat. Biotechnol. (1998) 16(7): 677-681. See also Klein et al. (2012), MAbs, 4(6): 653-663. Using the knob-into-holes method, the interaction surfaces of the two CH3 domains are altered to increase the heterodimerization of the two half-life extension domains containing the two altered CH3 domains. This occurs by introducing a bulky residue into the CH3 domain of one of the half-life extension domains, which acts as the "knob." Then, in order to accommodate the bulky residue, a "hole" is formed in the other half-life extension domain that can accommodate the knob. Either of the altered CH3 domains can be the "knob" while the other can be the "hole." The introduction of a disulfide bridge further stabilizes the heterodimers (Merchant, A. M., et al., Nat. Biotechnol.

(1998) 16(7); Atwell, S., et al., J. Mol. Biol. (1997) 270(1): 26-35) as well as increases yield.

It has been reported that heterodimerization yields above 97% can be achieved by introducing the S354C and T366W mutations in a heavy chain to create the "knob" and by introducing the Y349C, T366S, L368A, and Y407V mutations in a heavy chain to create the "hole" (numbering of the residues according to the Kabat EU numbering system). Carter et al. (2001), J. Immunol. Methods, 248: 7-15; Klein et al. (2012), MAbs, 4(6): 653-663.

In some embodiments comprising a first half-life extension domain and a second half-life extension domain, the first half-life extension domain comprises a heavy chain polypeptide or portion thereof (e.g., an Fc domain or fragment thereof) that comprises one or more amino acid mutations that create a "knob," and the second half-life extension domain comprises a heavy chain polypeptide or portion thereof (e.g., an Fc domain or fragment thereof) that comprises one or more amino acid mutations that create a "hole." In some embodiments comprising a first half-life extension domain and a second half-life extension domain, the first half-life extension domain comprises a heavy chain polypeptide or portion thereof (e.g., an Fc domain or fragment thereof) that comprises one or more amino acid mutations that create a "hole," and the second half-life extension domain comprises a heavy chain polypeptide or portion thereof (e.g., an Fc domain or fragment thereof) that comprises one or more amino acid mutations that create a "knob." Methods for introducing a hole or knob in a heavy chain polypeptide or portion thereof (e.g., an Fc domain or fragment thereof) is known in the art, e.g., in WO 1996/027011; Ridgway, J. B. et al., Protein Eng. (1996) 9(7): 617-621; Merchant, A. M., et al., Nat. Biotechnol. (1998) 16(7): 677-681; Klein et al. (2012), MAbs, 4(6): 653-663.

In some embodiments comprising a first half-life extension domain and a second half-life extension domain, the first half-life extension domain comprises a heavy chain polypeptide or portion thereof (e.g., an Fc domain or fragment thereof) that comprises the amino acid mutations S354C and T366W (numbered according to the Kabat EU numbering system), and the second half-life extension domain comprises a heavy chain polypeptide or portion thereof (e.g., an Fc domain or fragment thereof) that comprises the amino acid mutations Y349C, T366S, L368A, and Y407V (numbered according to the Kabat EU numbering system). In some embodiments comprising a first half-life extension domain and a second half-life extension domain, the first half-life extension domain comprises a heavy chain polypeptide or portion thereof (e.g., an Fc domain or fragment thereof) that comprises the amino acid mutations Y349C, T366S, L368A, and Y407V (numbered according to the Kabat EU numbering system), and the second half-life extension domain comprises a heavy chain polypeptide or portion thereof (e.g., an Fc domain or fragment thereof) that comprises the amino acid mutations S354C and T366W (numbered according to the Kabat EU numbering system). In some embodiments comprising a first half-life extension domain and a second half-life extension domain, the first half-life extension domain comprises an Fc domain or fragment thereof comprising the amino acid sequence of SEQ ID NO: 155, and the second half-life extension domain comprises an Fc domain or fragment thereof comprising the amino acid sequence of SEQ ID NO: 156. In some embodiments comprising a first half-life extension domain and a second half-life extension domain, the first half-life extension domain comprises an Fc domain or fragment thereof comprising the amino acid sequence of SEQ ID NO: 156, and the second half-life extension domain comprises an Fc domain or fragment thereof comprising the amino acid sequence of SEQ ID NO: 155. In some embodiments comprising a first half-life extension domain and a second half-life extension domain, the first half-life extension domain comprises an Fc domain or fragment thereof comprising the amino acid sequence of SEQ ID NO: 265, and the second half-life extension domain comprises an Fc domain or fragment thereof comprising the amino acid sequence of SEQ ID NO: 156. In some embodiments comprising a first half-life extension domain and a second half-life extension domain, the first half-life extension domain comprises an Fc domain or fragment thereof comprising the amino acid sequence of SEQ ID NO: 156, and the second half-life extension domain comprises an Fc domain or fragment thereof comprising the amino acid sequence of SEQ ID NO: 265. In some embodiments comprising a first half-life extension domain and a second half-life extension domain, the first half-life extension domain comprises an Fc domain or fragment thereof comprising the amino acid sequence of SEQ ID NO: 155, and the second half-life extension domain comprises an Fc domain or fragment thereof comprising the amino acid sequence of SEQ ID NO: 156. In some embodiments comprising a first half-life extension domain and a second half-life extension domain, the first half-life extension domain comprises an Fc domain or fragment thereof comprising the amino acid sequence of SEQ ID NO: 156, and the second half-life extension domain comprises an Fc domain or fragment thereof comprising the amino acid sequence of SEQ ID NO: 155.

Additional examples of substitutions that can be made to form knobs and holes include those described in US20140302037A1, the contents of which are herein incorporated by reference. For example, in some embodiments, any of the following amino acid substitutions can be made to a first half-life extension domain ("first domain") and a paired second half-life extension domain ("second domain") that each contain an Fc domain: (a) Y407T in the first domain and T366Y in the second domain; (b) Y407A in the first domain and T366W in the second domain; (c) F405A in the first domain and T394W in the second domain; (d) F405W in the first domain and T394S in the second domain; (e) Y407T in the first domain and T366Y in the second domain; (f) T366Y and F405A in the first domain and T394W and Y407T in the second domain; (g) T366W and F405W in the first domain and T394S and Y407A in the second domain; (h) F405W and Y407A in the first domain and T366W and T394S in the second domain; or (i) T366W in the first domain and T366S, L368A, and Y407V in the second domain, numbered according to the Kabat EU numbering system.

In some embodiments, any of the following amino acid substitutions can be made to a first half-life extension domain ("first domain") and a paired second half-life extension domain ("second domain") that each contain an Fc domain: (a) Y407T in the second domain and T366Y in the first domain; (b) Y407A in the second domain and T366W in the first domain; (c) F405A in the second domain and T394W in the first domain; (d) F405W in the second domain and T394S in the first domain; (e) Y407T in the second domain and T366Y in the first domain; (f) T366Y and F405A in the second domain and T394W and Y407T in the first domain; (g) T366W and F405W in the second domain and T394S and Y407A in the first domain; (h) F405W and Y407A in the second domain and T366W and T394S in the first domain; or (i) T366W in the second domain and T366S, L368A, and Y407V in the first domain, numbered according to the Kabat EU numbering system.

In embodiments comprising a first half-life extension domain and a second half-life extension domain that each comprise an Fc domain, any of the heterodimerizing alterations described herein can be used in the Fc domains to promote heterodimerization of any of the masked cytokines described herein. For instance, any of the heterodimerization alterations described herein, including combinations thereof, can be used to alter an amino acid sequence selected from the group consisting of SEQ ID NOs: 154-156, 158, 168, 169, 265, 616, 619, 622, 625, 721,772-774, 793, and 796.

b. Ionic/Electrostatic Interactions

Another strategy for promoting heterodimerization of two different half-life extension domains is by stabilizing ionic interactions that favor heterodimerization through altering charged residues.

In some embodiments, the masked cytokine comprises a first half-life extension domain and a second half-life extension domain, each of which comprises a CH3 domain. In some embodiments, the half-life extension domain comprising a CH3 domain is a heavy chain polypeptide or a fragment thereof (e.g., an Fc domain or fragment thereof). It has been observed that altering the charge polarities between two different Fc domains can result in ionic interactions such that heterodimerization is favored while homodimerization is suppressed. See, e.g., WO 2006/106905A1; Gunasekaran et al. (2010) 285(25): 19637-19646. For example, it was observed that negatively charged E356 pairs of an Fc domain pairs with positively charged K439 of another Fc domain, negatively charged E357, E357, and D399 of a first Fc domain pairs with positively charged K439, K370, and K409, respectively, of a second Fc domain. See WO 2006/106905A1; Gunasekaran et al. (2010) 285(25): 19637-19646. As such, by introducing at least two of the mutations of E356K, E357K, and D399K in a first Fc domain, and the mutations K370E, K409D, and K439E into a second Fc domain, efficient heterodimerization can be achieved while suppressing homodimer formation. Id. Efficient heterodimerization has been achieved by introducing K392D and K409D mutations in a first Fc chain, and by introducing D399K and E356K mutations in a second Fc chain Gunasekaran et al. (2010) 285(25): 19637-19646.

Additional examples of substitutions that can be made to charged pairs of amino acids include those described in US20140302037A1, the contents of which are herein incorporated by reference. For instance, in some embodiments, any of the following amino acid substitutions can be made to a first half-life extension domain ("first domain") and a paired second half-life extension domain ("second domain") that each contain an Fc domain: (a) K409E in the first domain and D399K in the second domain; (b) K409E in the first domain and D399R in the second domain; (c) K409D in the first domain and D399K in the second domain; (d) K409D in the first domain and D399R in the second domain; (e) K392E in the first domain and D399R in the second domain; (f) K392E in the first domain and D399K in the second domain; (g) K392D in the first domain and D399R in the second domain; (h) K392D in the first domain and D399K in the second domain; (i) K409D and K360D in the first domain and D399K and E356K in the second domain; (j) K409D and K370D in the first domain and D399K and E357K in the second domain; (k) K409D and K392D in the first domain and D399K, E356K, and E357K in the second domain; (l) K409D and K392D in the first domain and D399K in the second domain; (m) K409D and K392D in the first domain and D399K and E356K in the second domain; (n) K409D and K392D in the first domain and D399K and E357K in the second domain; (o) K409D and K370D in the first domain and D399K and D357K in the second domain; (p) D399K in the first domain and K409D and K360D in the second domain; and/or (q) K409D and K439D in the first domain and D399K and E356K in the second domain, numbered according to the Kabat EU numbering system.

In some embodiments, any of the following amino acid substitutions can be made to a first half-life extension domain ("first domain") and a paired second half-life extension domain ("second domain") that each contain an Fc domain: (a) K409E in the second domain and D399K in the first domain; (b) K409E in the second domain and D399R in the first domain; (c) K409D in the second domain and D399K in the first domain; (d) K409D in the second domain and D399R in the first domain; (e) K392E in the second domain and D399R in the first domain; (f) K392E in the second domain and D399K in the first domain; (g) K392D in the second domain and D399R in the first domain; (h) K392D in the second domain and D399K in the first domain; (i) K409D and K360D in the second domain and D399K and E356K in the first domain; (j) K409D and K370D in the second domain and D399K and E357K in the first domain; (k) K409D and K392D in the second domain and D399K, E356K, and E357K in the first domain; (l) K409D and K392D in the second domain and D399K in the first domain; (m) K409D and K392D in the second domain and D399K and E356K in the first domain; (n) K409D and K392D in the second domain and D399K and E357K in the first domain; (o) K409D and K370D in the second domain and D399K and D357K in the first domain; (p) D399K in the second domain and K409D and K360D in the first domain; and/or (q) K409D and K439D in the second domain and D399K and E356K in the first domain, numbered according to the Kabat EU numbering system.

In some embodiments, any of the following amino acid substitutions can be made to a first half-life extension domain ("first domain") and a paired second half-life extension domain ("second domain") that each contain an Fc domain: (a) K409D or K409E in the first domain and D399K or D399R in the second domain; (b) K392D or K392E in the first domain and D399K or D399R in the second domain; (c) K439D or K439E in the first domain and E356K or E356R in the second domain; and/or (d) K370D or K370E in the first domain and E357K or E357R in the second domain, numbered according to the Kabat EU numbering system.

In some embodiments, any of the following amino acid substitutions can be made to a first half-life extension domain ("first domain") and a paired second half-life extension domain ("second domain") that each contain an Fc domain: (a) K409D or K409E in the second domain and D399K or D399R in the first domain; (b) K392D or K392E in the second domain and D399K or D399R in the first domain; (c) K439D or K439E in the second domain and E356K or E356R in the first domain; and/or (d) K370D or K370E in the second domain and E357K or E357R in the first domain, numbered according to the Kabat EU numbering system.

In some embodiments comprising a first half-life extension domain and a second half-life extension domain that each comprise an Fc domain, one or more of the following substitutions may be further included in both the first half-life extension domain and the second half-life extension domain to stabilize the heterodimers: R355D, R355E, K360D, and K360R.

In some embodiments comprising a first half-life extension domain and a second half-life extension domain, the first half-life extension domain comprises a heavy chain polypeptide or portion thereof (e.g., an Fc domain or fragment thereof) that comprises one or more mutations that promote stabilizing ionic interactions with the second half-life extension domain while suppressing homodimerization, and the second half-life extension domain comprises one or more mutations that promote stabilizing ionic interactions with the first half-life extension domain while suppressing homodimerization.

In some embodiments comprising a first half-life extension domain and a second half-life extension domain, the first half-life extension domain comprises a heavy chain polypeptide or portion thereof (e.g., an Fc domain or fragment thereof) that comprises the amino acid mutations K392D and K409D (numbered according to the Kabat EU numbering system), and the second half-life extension domain comprises a heavy chain polypeptide or portion thereof (e.g., an Fc domain or fragment thereof) that comprises the amino acid mutations D399K and E356K (numbered according to the Kabat EU numbering system).

In embodiments comprising a first half-life extension domain and a second half-life extension domain that each comprise an Fc domain, any of the heterodimerizing alterations described herein can be used in the Fc domains to promote heterodimerization of any of the masked cytokines described herein. For instance, any of the heterodimerization alterations described herein, including combinations thereof, can be used to alter an amino acid sequence selected from the group consisting of SEQ ID NOs: 154-156, 158, 168, 169, 265, 616, 619, 622, 625, 721,772-774, 793, and 796.

c. Structural and Sequenced-Based Approaches

Another strategy for promoting heterodimerization of two different half-life extension domains is by using structure- and sequence-based approaches to identify alterations that could promote heterodimerization and/or suppress homodimerization.

Among the ways of identifying alterations that promote heterodimerization is by performing structural calculations to determine the energies of paired variant combinations for residues that interact across the CH3-CH3 dimer interface, as was the approach taken in Moore et al. (2011) 3(6): 546-557, the contents of which are herein incorporated by reference. Moore et al. identified the pairs that were predicted to have lower energy in the heterodimer form relative to the homodimer form as a starting point for further analysis. It was observed that a heterodimerization yield of 89% could be achieved by introducing S364H and F405A mutations in a first Fc domain and by introducing Y349T and T394F mutations in a second Fc domain. Id.

In some embodiments comprising a first half-life extension domain and a second half-life extension domain that each comprise an Fc domain, the first half-life extension domain comprises amino acid mutations of S364H and F405A, and the second half-life extension domain comprises amino acid mutations of Y349T and T394F, numbered according to the Kabat EU numbering system. In some embodiments comprising a first half-life extension domain and a second half-life extension domain that each comprise an Fc domain, the second half-life extension domain comprises amino acid mutations of S364H and F405A, and the first half-life extension domain comprises amino acid mutations of Y349T and T394F, numbered according to the Kabat EU numbering system.

In embodiments comprising a first half-life extension domain and a second half-life extension domain that each comprise an Fc domain, any of the heterodimerizing alterations described herein can be used in the Fc domains to promote heterodimerization of any of the masked cytokines described herein. For instance, any of the heterodimerization alterations described herein, including combinations thereof, can be used to alter an amino acid sequence selected from the group consisting of SEQ ID NOs: 154-156, 158, 168, 169, 265, 616, 619, 622, 625, 721,772-774, 793, and 796.

E. Binding Assays

The strength, or affinity of immunological binding interactions, such as between a cytokine or functional fragment thereof and a binding partner (e.g., a target protein, such as a cytokine receptor) for which the cytokine or functional fragment thereof is specific, can be expressed in terms of the dissociation constant (Kd) of the interaction, wherein a smaller Kd represents a greater affinity. For example, the binding of the IL-2 cytokine to the IL-2R cytokine receptor (e.g., the IL-2R or a component thereof, such as IL-2Rα, IL-2Rβ, IL-2Rγ, or combinations thereof), can be expressed in terms of the Kd. In some embodiments, the immunological binding interactions are between a masked cytokine (in the presence or absence of a protease) and a target protein, such as a cytokine receptor. In the context of IL-2 cytokine binding, the target protein could be the IL-2R (comprising the IL-2Rα, IL-2Rβ, and IL-2Rγ chains), the IL-2Rα chain, the IL-2Rβ chain, or the IL-2Rα/β dimeric complex Immunological binding properties of proteins can be quantified using methods well known in the art. For example, one method comprises measuring the rates of cytokine receptor (e.g., IL-2R)/cytokine (e.g., IL-2) complex formation and dissociation, wherein those rates depend on the concentrations of the complex partners, the affinity of the interaction, and geometric parameters that equally influence the rate in both directions. Both the "on rate constant" (Kon) and the "off rate constant" (Koff) can be determined by calculation of the concentrations and the actual rates of association and dissociation. The ratio of Koff/Kon enables the cancelation of all parameters not related to affinity, and is equal to the dissociation constant Kd. See Davies et al., Annual Rev Biochem. 59:439-473, (1990).

In some aspects, a masked cytokine described herein binds to a target protein with about the same or higher affinity upon cleavage with a protease as compared to the parental cytokine that comprises a masking moiety but does not comprise a cleavable peptide. The target protein can be any cytokine receptor. In some embodiments, the target protein is IL-2R (comprising the IL-2Rα, IL-2Rβ, and IL-2Rγ chains) In some embodiments, the target protein is IL-2Rα. In some embodiments, the target protein is IL-2Rβ. In some embodiments, the target protein is the IL-2Rα/β dimeric complex. In some embodiments, the target protein is IL-15R (comprising the IL-15Rα, IL-2Rβ, and IL-2Rγ chains), or is a component thereof, such as IL-15Rα, IL-2Rβ, or IL-2Rγ, or a combination thereof.

In some embodiments, a masked cytokine provided herein that does not comprise a cleavable peptide in the linker has a dissociation constant (Kd) of ≤1 µM, ≤150 nM, ≤100 nM, ≤50 nM, ≤10 nM, ≤1 nM, ≤0.1 nM, ≤0.01 nM, or ≤0.001 nM (e.g. 10-8 M or less, e.g. from 10-8 M to 10-13 M, e.g., from 10-9 M to 10-13 M) with the target protein. In some embodiments, a masked cytokine provided herein that comprises a cleavable peptide in the linker has a dissociation constant (Kd) of ≤1 µM, ≤150 nM, ≤100 nM, ≤50 nM, ≤10 nM, ≤1 nM, ≤0.1 nM, ≤0.01 nM, or ≤0.001 nM (e.g. 10-8 M or less, e.g. from 10-8 M to 10-13 M, e.g., from 10-9 M to 10-13 M) with the target protein prior to cleavable with a protease. In some embodiments, a masked cytokine provided herein that comprises a cleavable peptide in the linker has a dissociation constant (Kd) of ≤1 µM, ≤150 nM, ≤100 nM, ≤50 nM, ≤10 nM, ≤1 nM, ≤0.1 nM, ≤0.01 nM, or ≤0.001 nM (e.g. 10-8 M or less, e.g. from 10-8 M to 10-13 M, e.g., from 10-9 M to 10-13 M) with the target protein upon cleavage with a protease. In some embodiments, the cytokine or functional fragment thereof of a masked cytokine provided herein has a dissociation constant (Kd) of ≥500 µM, ≥250 µM, ≥200 µM, ≥150 µM, ≥100 µM, ≥50 µM, ≤10 µM, ≤1 µM, ≥500 nM, ≥250 nM, ≥150 nM, ≥100 nM, ≥50 nM, ≥10 nM, ≥1 nM, ≥0.1 nM, ≥0.01 nM, or ≥0.001 nM with the masking moiety of the masked cytokine. In some embodiments, the cytokine or functional fragment thereof of a masked cytokine provided herein has a dissociation constant (Kd) that is between about 200 µM and about 50 nM, such as about or at least about 175 µM, about or at least about 150 µM, about or at least about 125 µM, about or at least about 100 µM, about or at least about 75 µM, about or at least about 50 µM, about or at least about 25 µM, about or at least about 5 µM, about or at least about 1 µM, about or at least about 750 nM, about or at least about 500 nM, about or at least about 250 nM, about or at least about 150 nM, about or at least about 100 nM, about or at least about 75 nM, or about or at least about 50 nM. Assays for assessing binding affinity are well known in the art.

In some aspects, masked cytokines that exhibit a desired occlusion ratio are provided. The term "occlusion ratio" as used herein refers a ratio of (a) a maximum detected level of a parameter under a first set of conditions to (b) a minimum detected value of that parameter under a second set of conditions. For example, in the context of a masked IL-2 polypeptide, the occlusion ratio refers to the ratio of (a) a maximum detected level of target protein (e.g., IL-2R protein) binding to the masked IL-2 polypeptide in the presence of at least one protease capable of cleaving the cleavable peptide of the masked IL-2 polypeptide to (b) a minimum detected level of target protein (e.g., IL-2R protein) binding to the masked IL-2 polypeptide in the absence of the protease. Thus, the occlusion ratio for a masked cytokine can be calculated by dividing the EC50 of the masked cytokine pre-cleavage by the EC50 of the masked cytokine post-cleavage. The occlusion ratio of a masked cytokine can also be calculated as the ratio of the dissociation constant of the masked cytokine before cleavage with a protease to the dissociation constant of the masked cytokine after cleavage with a protease. In some embodiments, a greater occlusion ratio for the masked cytokine indicates that target protein bound by the masked cytokine occurs to a greater extent (e.g., predominantly occurs) in the presence of a protease capable of cleaving the cleavable peptide of the masked cytokine than in the absence of a protease.

In some embodiments, masked cytokines with an optimal occlusion ratio are provided herein. In some embodiments, an optimal occlusion ratio of a masked cytokine indicates the masked cytokine has desirable properties useful for the methods or compositions contemplated herein. In some embodiments, a masked cytokine provided herein exhibits an optimal occlusion ratio of about 2 to about 10,000, e.g., about 80 to about 100. In a further embodiment of any of the masked cytokine provided herein, the occlusion ratio is about 2 to about 7,500, about 2 to about 5,000, about 2 to about 2,500, about 2 to about 2,000, about 2 to about 1,000, about 2 to about 900, about 2 to about 800, about 2 to about 700, about 2 to about 600, about 2 to about 500, about 2 to about 400, about 2 to about 300, about 2 to about 200, about 2 to about 100, about 2 to about 50, about 2 to about 25, about 2 to about 15, about 2 to about 10, about 5 to about 10, about 5 to about 15, about 5 to about 20, about 10 to about 100, about 20 to about 100, about 30 to about 100, about 40 to about 100, about 50 to about 100, about 60 to about 100, about 70 to about 100, about 80 to about 100, or about 100 to about 1,000. In some embodiments, a masked cytokine provided herein exhibits an optimal occlusion ratio of about 2 to about 1,000. Binding of a masked IL-2 polypeptide to a target protein before cleavage and/or after cleavage with a protease can be determined using techniques well known in the art such as by ELISA.

In some embodiments, a masking moiety described herein binds to a cytokine or functional fragment thereof as described herein with lower affinity than the affinity between the cytokine or functional fragment thereof and a target protein (e.g., cytokine receptor). In certain embodiments, a masking moiety provided herein binds to a cytokine or functional fragment thereof as described herein with a dissociation constant (Kd) of ≥500 µM, ≥250 µM, ≥200 µM, ≥150 µM, ≥100 µM, ≥50 µM, ≥10 µM, ≥1 µM, ≥500 nM, ≥250 nM, ≥150 nM, ≥100 nM, ≥50 nM, ≥10 nM, ≥1 nM, ≥0.1 nM, ≥0.01 nM, or ≥0.001 nM.

II. MASKED CYTOKINE PRODUCTION

The masked cytokines described herein are prepared using techniques available in the art, exemplary methods of which are described.

A. Antibody Production

Some embodiments of the masked cytokine comprise an antibody or fragment thereof. The following sections provide further detail on the production of antibodies and antibody fragments, variants, and derivatives thereof, that may be used in some embodiments of the masked cytokine provided herein. In some embodiments, the masked cytokine is in the form of a dimer produced by two copies of a masked cytokine that are associated through disulfide bonds.

1. Antibody Fragments

The present invention encompasses, in some embodiments, antibody fragments. The antibody fragments can be any antibody fragments, such as an Fc domain, a portion of the heavy chain, a portion of the light chain, an Fab, an Fv, or an scFv, among other fragments. Antibody fragments may be generated by traditional means, such as enzymatic digestion, or by recombinant techniques. In certain circumstances, there are advantages of linking antibody fragments, rather than whole antibodies, to the masked cytokines described herein. For a review of certain antibody fragments, see Hudson et al. (2003) Nat. Med. 9:129-134.

Various techniques have been developed for the production of antibody fragments. Traditionally, these fragments were derived via proteolytic digestion of intact antibodies (see, e.g., Morimoto et al., Journal of Biochemical and Biophysical Methods 24:107-117 (1992); and Brennan et al., Science, 229:81 (1985)). However, these fragments can now be produced directly by recombinant host cells. Fab, Fv and ScFv antibody fragments can all be expressed in and secreted from *E. coli* and other cell types, such as HEK293 and CHO cells, thus allowing the facile production of large amounts of these fragments. Alternatively, Fab'-SH fragments can be directly recovered from culture media and chemically coupled to form F(ab')2 fragments (Carter et al., Bio/Technology 10: 163-167 (1992)). According to another approach, F(ab')2 fragments can be isolated directly from recombinant host cell culture. Fab and F(ab')2 fragments with increased in vivo half-life comprising FcRN/salvage receptor binding epitope residues are described in U.S. Pat. No. 5,869,046. Other techniques for the production of antibody fragments for use in the masked cytokines will be apparent to the skilled practitioner. In certain embodiments, a masked cytokine comprises a single chain Fv fragment (scFv). See WO 93/16185; U.S. Pat. Nos. 5,571,894; and 5,587,458. scFv fusion proteins may be constructed to yield fusion of an effector protein at either the amino or the carboxy terminus of an scFv. See Antibody Engineering, ed. Borrebaeck, supra. Also, in some embodiments, bi-scFv comprising two scFvs linked via a polypeptide linker can be used with the masked cytokines.

The present invention includes, in some embodiments, a linear antibody (e.g., as described in U.S. Pat. No. 5,641, 870) or a single chain immunoglobulin comprising heavy and light chain sequences of the antibody linked via an appropriate linker. Such linear antibodies or immunoglobulins may be monospecific or bispecific. Such a single chain immunoglobulin can be dimerized to thereby maintain a structure and activities similar to those of the antibody, which is originally a tetramer. Also, in some embodiments, the antibody or fragment thereof may be an antibody that has a single heavy chain variable region and has no light chain sequence. Such an antibody is called a single domain antibody (sdAb) or a nanobody. These antibodies are also encompassed in the meaning of the functional fragment of the antibody according to the present invention. Antibody fragments can be linked to the masked cytokines described herein according to the guidance provided herein.

2. Humanized Antibodies

The invention encompasses, in some embodiments, humanized antibodies or antibody fragments thereof. In some embodiments, the humanized antibodies can be any antibodies, including any antibody fragment. Various methods for humanizing non-human antibodies are known in the art. For example, a humanized antibody can have one or more amino acid residues introduced into it from a source which is non-human. These non-human amino acid residues are often referred to as "import" residues, which are typically taken from an "import" variable domain. Humanization can be essentially performed following the method of Winter (Jones et al. (1986) Nature 321:522-525; Riechmann et al. (1988) Nature 332:323-327; Verhoeyen et al. (1988) Science 239:1534-1536), by substituting hypervariable region sequences for the corresponding sequences of a human antibody. Accordingly, such "humanized" antibodies are chimeric antibodies (U.S. Pat. No. 4,816,567) wherein substantially less than an intact human variable domain has been substituted by the corresponding sequence from a non-human species. In practice, humanized antibodies are typically human antibodies in which some hypervariable region residues and possibly some FR residues are substituted by residues from analogous sites in rodent antibodies. Humanized antibodies can be linked to the masked cytokines described herein according to the guidance provided herein.

3. Human Antibodies

Human antibodies of some embodiments of the invention can be constructed by combining Fv clone variable domain sequence(s) selected from human-derived phage display libraries with known human constant domain sequences(s). Alternatively, human monoclonal antibodies of some embodiments of the invention can be made by the hybridoma method, e.g., by using mouse, rat, bovine (e.g., cow), or rabbit cells, for example, to produce the human monoclonal antibodies. In some embodiments, the human antibodies and human monoclonal antibodies can be antibodies that bind to any antigen. In some embodiments, human monoclonal antibodies of the invention can be made by immunizing a non-human animal that comprises human immunoglobulin loci with the target antigen, and isolating the antibody from the immunized animal or from cells derived from the immunized animal Examples of suitable non-human animals include a transgenic or transchromosomic animal, such as HuMAb Mouse® (Medarex, Inc.), KM Mouse®, "TC mice," and Xenomouse™. See, e.g., Lonberg, et al. (1994) Nature 368: 856-859; Fishwild, D. et al. (1996) Nature Biotechnology 14: 845-851; WO2002/43478; U.S. Pat. Nos. 5,939,598; 6,075,181; 6,114,598; 6,150,584; 6,162,963; and Tomizuka et al. (2000) Proc. Natl. Acad. Sci. USA 97:722-727.

Human myeloma and murine-human heteromyeloma cell lines for the production of human monoclonal antibodies have been described, for example, by Kozbor J. Immunol., 133: 3001 (1984); Brodeur et al., Monoclonal Antibody Production Techniques and Applications, pp. 51-63 (Marcel Dekker, Inc., New York, 1987); and Boerner et al., J. Immunol., 147: 86 (1991). Human antibodies can be linked to the masked cytokines described herein according to the guidance provided herein.

4. Bispecific Antibodies

Bispecific antibodies are monoclonal antibodies that have binding specificities for at least two different antigens. In certain embodiments, bispecific antibodies are human or humanized antibodies. In some embodiments, one of the binding specificities is for a first antigen and the other binding specificity is for a second antigen, which may be either two different epitopes on the same target protein, or two different epitopes on two different target proteins. Bispecific antibodies may also be used to localize cytotoxic agents to cells which express the first antigen and/or the second antigen. Bispecific antibodies may also be used to recruit cells, such as T cells or natural killer cells, to kill certain cells, e.g., cancer cells. Bispecific antibodies can be prepared as full-length antibodies or antibody fragments (e.g. F(ab')2 bispecific antibodies). Bispecific antibodies can be linked to the masked cytokines described herein according to the guidance provided herein.

Methods for making bispecific antibodies are known in the art. See Milstein and Cuello, Nature, 305: 537 (1983), WO 93/08829 published May 13, 1993, Traunecker et al., EMBO J., 10: 3655 (1991); Kontermann and Brinkmann, Drug Discovery Today, 20(7):838-847. For further details of generating bispecific antibodies see, for example, Suresh et al., Methods in Enzymology, 121:210 (1986). Bispecific antibodies include cross-linked or "heteroconjugate" antibodies. For example, one of the antibodies in the heteroconjugate can be coupled to avidin, the other to biotin. Heteroconjugate antibodies may be made using any convenient cross-linking method. Suitable cross-linking agents are well known in the art, and are disclosed in U.S. Pat. No. 4,676,980, along with a number of cross-linking techniques.

5. Single-Domain Antibodies

In some embodiments, a single-domain antibody is linked to the masked cytokine in accordance with the guidance provided herein. The single-domain antibody can be any antibody. A single-domain antibody is a single polypeptide chain comprising all or a portion of the heavy chain variable domain or all or a portion of the light chain variable domain of an antibody. In certain embodiments, a single-domain antibody is a human single-domain antibody (Domantis, Inc., Waltham, Mass.; see, e.g., U.S. Pat. No. 6,248,516 B1). In some embodiments, a single-domain antibody consists of all or a portion of the heavy chain variable domain of an antibody. In some embodiment, the single domain antibody is a camelid-derived antibody obtained by immunization of a camelid with the target antigen. In some embodiments, the single domain antibody is a shark-derived antibody obtained by immunization of a shark with the target antigen. In some embodiments, the single domain antibody is a Nanobody (see, e.g., WO 2004041865A2 and US20070269422A1).

6. Antibody Variants

In some embodiments, amino acid sequence modification(s) of the antibodies or fragments thereof described herein are contemplated. For example, it may be desirable to improve the FcRn-binding affinity and/or pH-dependent FcRn-binding affinity of the antibody. It may also be desirable to promote heterodimerization of antibody heavy chains by introducing certain amino acid modifications. Methods for promoting heterodimerization of antibody chains, including certain modifications that can be made to facilitate heterodimerization, is described by Klein et al. (2012), MAbs, 4(6): 653-663.

Amino acid sequence variants of the antibody may be prepared by introducing appropriate changes into the nucleotide sequence encoding the antibody, or by peptide synthesis. Such modifications include, for example, deletions from, and/or insertions into and/or substitutions of, residues within the amino acid sequences of the antibody. Any combination of deletion, insertion, and substitution can be made to arrive at the final construct, provided that the final construct possesses the desired characteristics. The amino acid alterations may be introduced in the subject antibody amino acid sequence at the time that sequence is made.

A useful method for identification of certain residues or regions of the antibody that are preferred locations for mutagenesis is called "alanine scanning mutagenesis" as described by Cunningham and Wells (1989) Science, 244: 1081-1085. Here, a residue or group of target residues are identified (e.g., charged residues such as arg, asp, his, lys, and glu) and replaced by a neutral or negatively charged amino acid (e.g., alanine or polyalanine) to affect the interaction of the amino acids with antigen. Those amino acid locations demonstrating functional sensitivity to the substitutions then are refined by introducing further or other variants at, or for, the sites of substitution. Thus, while the site for introducing an amino acid sequence variation is predetermined, the nature of the mutation per se need not be predetermined. For example, to analyze the performance of a mutation at a given site, ala scanning or random mutagenesis is conducted at the target codon or region and the expressed immunoglobulins are screened for the desired activity.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme or a polypeptide which increases the serum half-life of the antibody.

In some embodiments, the masked cytokine is modified to eliminate, reduce, or otherwise hinder protease cleavage near the hinge region. The "hinge region" of an IgG is generally defined as including E216 and terminating at P230 of human IgG1 according to the EU index as in Kabat, but, functionally, the flexible portion of the chain may be considered to include additional residues termed the upper and lower hinge regions, such as from E216 to G237 (Roux et al., 1998 J Immunol 161:4083) and the lower hinge has been referred to as residues 233 to 239 of the Fc region where FcγR binding was generally attributed. Modifications to any of the masked cytokines described herein, can be performed, for example, according to the methods described in US 20150139984A1, which is incorporated herein by reference, as well as by incorporating any of the modifications described therein.

In some embodiments, FcRn mutations that improve pharmacokinetics include, but are not limited to, M428L, T250Q/M428L, M252Y/S254T/T256E, P257I/N434H, D376V/N434H, P257I/Q311I, N434A, N434W, M428L/N434S, V259I/V308F, M252Y/S254T/T256E, V259I/V308F/M428L, T307Q/N434A, T307Q/N434S, T307Q/E380A/N434A, V308P/N434A, N434H, V308P. In some embodiments, such mutations enhance antibody binding to FcRn at low pH but do not change the antibody affinity at neutral pH.

In certain embodiments, an antibody or fragment thereof is altered to increase or decrease the extent to which the antibody is glycosylated. Glycosylation of polypeptides is typically either N-linked or O-linked. N-linked refers to the attachment of a carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain Thus, the presence of either of these tripeptide sequences in a polypeptide creates a potential glycosylation site. O-linked glycosylation refers to the attachment of one of the sugars N-aceylgalactosamine, galactose, or xylose to a hydroxyamino acid, most commonly serine or threonine, although 5-hydroxyproline or 5-hydroxylysine may also be used.

Addition or deletion of glycosylation sites to the masked cytokine is conveniently accomplished by altering the amino acid sequence such that one or more of the above-described tripeptide sequences (for N-linked glycosylation sites) is created or removed. The alteration may also be made by the addition, deletion, or substitution of one or more serine or threonine residues to the sequence of the original antibody (for O-linked glycosylation sites).

Where the antibody or fragment thereof comprises an Fc region, the carbohydrate attached thereto may be altered. For example, antibodies with a mature carbohydrate structure that lacks fucose attached to an Fc region of the antibody are described in US Pat Appl No US 2003/0157108 (Presta, L.). See also US 2004/0093621 (Kyowa Hakko Kogyo Co., Ltd). Antibodies with a bisecting N-acetylglucosamine (GlcNAc) in the carbohydrate attached to an Fc region of the antibody are referenced in WO 2003/011878, Jean-Mairet et al. and U.S. Pat. No. 6,602,684, Umana et al. Antibodies with at least one galactose residue in the oligosaccharide attached to an Fc region of the antibody are reported in WO 1997/30087, Patel et al. See, also, WO 1998/58964 (Raju, S.) and WO 1999/22764 (Raju, S.) concerning antibodies with altered carbohydrate attached to the Fc region thereof. See also US 2005/0123546 (Umana et al.) on antigen-binding molecules with modified glycosylation.

In certain embodiments, a glycosylation variant comprises an Fc region, wherein a carbohydrate structure attached to the Fc region lacks fucose or has reduced fucose. Such variants have improved ADCC function. Optionally, the Fc region further comprises one or more amino acid substitutions therein which further improve ADCC, for example, substitutions at positions 298, 333, and/or 334 of the Fc region (Eu numbering of residues). Examples of publications related to "defucosylated" or "fucose-deficient" antibodies include: US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; Okazaki et al. J. Mol. Biol. 336:1239-1249 (2004); Yamane-Ohnuki et al. Biotech. Bioeng. 87: 614 (2004). Examples of cell lines producing defucosylated antibodies include Lec13 CHO cells deficient in protein fucosylation (Ripka et al. Arch. Biochem. Biophys. 249: 533-545 (1986); US Pat Appl No US 2003/0157108 A1, Presta, L; and WO 2004/056312 A1, Adams et al., especially at Example 11), and knockout cell lines, such as alpha-1,6-fucosyltransferase gene, FUT8, knockout CHO cells (Yamane-Ohnuki et al. Biotech. Bioeng. 87: 614 (2004)), and cells overexpressing β1,4-N-acetylglycosminyltransferase III (GnT-III) and Golgi μ-mannosidase II (ManII)

In any of the embodiments herein, the masked cytokine can be engineered to improve antibody-dependent cell-mediated cytotoxicity (ADCC) activity. In some embodiments, the masked cytokine may be produced in a cell line having a alpha1,6-fucosyltransferase (Fut8) knockout. In some embodiments, the host cells have been modified to have reduced intrinsic alpha1,6-fucosylation activity. Examples of methods for modifying the fucosylation pathways in mammalian host cells can be found in, e.g., Yamane-Ohnuki and Satoh, MAbs, 1(3): 230-236 (2009), the contents of which are incorporated herein by reference. Examples of methods and compositions for partially or completely inactivating the expression of the FUT8 gene can be found in, e.g., US Pub. No. 20160194665A1; WO2006133148A2, the contents of which are incorporated herein by reference. In some embodiments, the masked cytokine is produced in the Lec13 variant of CHO cells (see, e.g., Shields et al., J. Biol. Chem., 277(30):26733-40 (2002)) or the YB2/0 cell line having reduced FUT8 activity (see, e.g., Shinkawa et al., J. Biol. Chem., 278(5): 3466-73 (2003)). In some embodiments, small interfering RNA (siRNA) against genes relevant to alpha1,6-fucosylation can be introduced (see, e.g., Mori et al., Biotechnol. Bioeng. 88(7): 901-908 (2004); Imai-Nishiya et al., BMC Biotechnol. 7: 84 (2007); Omasa et al., J. Biosci. Bioeng., 106(2): 168-173 (2008)). In some further embodiments, the masked cytokine may be produced in a cell line overexpressing β1,4-N-acetylglycosminyltransferase III (GnT-III). In further embodiments, the cell line additionally overexpresses Golgi μ-mannosidase II (ManII) In some of the embodiments herein, the masked cytokine may comprise at least one amino acid substitution in the Fc region that improves ADCC activity.

In some embodiments, the masked cytokine is altered to improve its serum half-life. To increase the serum half-life of the cytokine, one may incorporate a FcRN/salvage receptor binding epitope into a linked antibody (especially an antibody fragment) as described in U.S. Pat. No. 5,739,277, for example. As used herein, the term "salvage receptor binding epitope" refers to an epitope of the Fc region of an IgG molecule (e.g., IgG1, IgG2, IgG3, or IgG4) that is responsible for increasing the in vivo serum half-life of the IgG molecule (US 2003/0190311, U.S. Pat. Nos. 6,821,505; 6,165,745; 5,624,821; 5,648,260; 6,165,745; 5,834,597).

Another type of variant is an amino acid substitution variant. These variants have at least one amino acid residue in the antibody molecule replaced by a different residue. Sites of interest for substitutional mutagenesis include the hypervariable regions, but FR alterations are also contemplated. Conservative substitutions are shown in Table 3 under the heading of "preferred substitutions." If such substitutions result in a desirable change in biological activity, then more substantial changes, denominated "exemplary substitutions" in Table 3, or as further described below in reference to amino acid classes, may be introduced and the products screened.

TABLE 3

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Substantial modifications in the biological properties of the antibody are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or c) the bulk of the side chain Amino acids may be grouped according to similarities in the properties of their side chains (in A. L. Lehninger, in Biochemistry, second ed., pp. 73-75, Worth Publishers, New York (1975)):
  (1) non-polar: Ala (A), Val (V), Leu (L), Ile (I), Pro (P), Phe (F), Trp (W), Met (M)
  (2) uncharged polar: Gly (G), Ser (S), Thr (T), Cys (C), Tyr (Y), Asn (N), Gln (Q)
  (3) acidic: Asp (D), Glu (E)
  (4) basic: Lys (K), Arg (R), His (H)
Alternatively, naturally occurring residues may be divided into groups based on common side-chain properties:
  (1) hydrophobic: Norleucine, Met, Ala, Val, Leu, Ile;
  (2) neutral hydrophilic: Cys, Ser, Thr, Asn, Gln;
  (3) acidic: Asp, Glu;
  (4) basic: His, Lys, Arg;
  (5) residues that influence chain orientation: Gly, Pro;
  (6) aromatic: Trp, Tyr, Phe.
Non-conservative substitutions will entail exchanging a member of one of these classes for another class. Such substituted residues also may be introduced into the conservative substitution sites or, into the remaining (non-conserved) sites.

Another type of substitutional variant involves the substitution of a naturally occurring amino acid residue for a non-naturally occurring amino acid residue. Non-naturally occurring amino acid residues can be incorporated, e.g., through tRNA recoding, or through any of the methods as described, e.g., in WO 2016154675A1, which is incorporated herein by reference.

One type of substitutional variant involves substituting one or more hypervariable region residues of a parent antibody (e.g., a humanized or human antibody). Generally, the resulting variant(s) selected for further development will have modified (e.g., improved) biological properties relative to the parent antibody from which they are generated. A convenient way for generating such substitutional variants involves affinity maturation using phage display, yeast display, or mammalian display. Briefly, several hypervariable region sites (e.g., 6-7 sites) are mutated to generate all possible amino acid substitutions at each site. The antibodies thus generated are displayed from filamentous phage particles as fusions to at least part of a phage coat protein (e.g., the gene III product of M13) packaged within each particle. The phage-displayed variants are then screened for their biological activity (e.g., binding affinity). In order to identify candidate hypervariable region sites for modification, scanning mutagenesis (e.g., alanine scanning) can be performed to identify hypervariable region residues contributing significantly to antigen binding. Alternatively, or additionally, it may be beneficial to analyze a crystal structure of the antigen-antibody complex to identify contact points between the antibody and antigen. Such contact residues and neighboring residues are candidates for substitution according to techniques known in the art, including those elaborated herein. Once such variants are generated, the panel of variants is subjected to screening using techniques known in the art, including those described herein, and antibodies with superior properties in one or more relevant assays may be selected for further development.

Nucleic acid molecules encoding amino acid sequence variants of the masked cytokines are prepared by a variety of methods known in the art. These methods include, but are not limited to, isolation from a natural source (in the case of naturally occurring amino acid sequence variants) or preparation by oligonucleotide-mediated (or site-directed) mutagenesis, PCR mutagenesis, and cassette mutagenesis of an earlier prepared variant or a non-variant version of the antibody, for example.

It may be desirable to introduce one or more amino acid modifications in an Fc region of antibodies of the invention, thereby generating an Fc region variant. The Fc region variant may comprise a human Fc region sequence (e.g., a human IgG1, IgG2, IgG3 or IgG4 Fc region) comprising an amino acid modification (e.g. a substitution) at one or more amino acid positions including that of a hinge cysteine.

In some embodiments, a masked cytokine provided herein includes an antibody or fragment thereof having an IgG1, IgG2, IgG3, or IgG4 isotype with enhanced effector function. In some embodiments, a masked cytokine provided herein includes an antibody or fragment thereof having an IgG1 isotype with enhanced effector function. In some embodiments, a masked cytokine provided herein (e.g., a masked IL-2 polypeptide or functional fragment thereof or a masked IL-15 polypeptide or functional fragment thereof) has an IgG1 isotype with enhanced effector function. In some embodiments, the masked cytokine is afucosylated. In some embodiments, the masked cytokine has increased levels of mannose moieties. In some embodiments, the masked cytokine has increased levels of bisecting glycan moieties. In some embodiments, the IgG1 comprises amino acid mutations.

In some embodiments, a masked cytokine provided herein includes an antibody having an IgG1 isotype (e.g., a human IgG1 isotype). In some embodiments, the IgG1 comprises one or more amino acid substitutions that enhance effector function. In one embodiment, the IgG1 comprises the amino acid substitutions S298A, E333A, and K334A wherein the amino acid residues are numbered according to the EU index as in Kabat. In one embodiment, the IgG1 comprises the amino acid substitutions S239D and I332E wherein the amino acid residues are numbered according to the EU index as in Kabat. In one embodiment, the IgG1 comprises the amino acid substitutions S239D, A330L, and I332E wherein the amino acid residues are numbered according to the EU index as in Kabat. In one embodiment, the IgG1 comprises the amino acid substitutions P2471 and A339D or A339Q wherein the amino acid residues are numbered according to the EU index as in Kabat. In one embodiment, the IgG1 comprises the amino acid substitutions D280H, K290S with or without S298D or S298V wherein the amino acid residues are numbered according to the EU index as in Kabat. In one embodiment, the IgG1 comprises the amino acid substitutions F243L, R292P, and Y300L wherein the amino acid residues are numbered according to the EU index as in Kabat. In one embodiment, the IgG1 comprises the amino acid substitutions F243L, R292P, Y300L, and P396L wherein the amino acid residues are numbered according to the EU index as in Kabat. In one embodiment, the IgG1 comprises the amino acid substitutions F243L, R292P, Y300L, V305I, and P396L wherein the amino acid residues are numbered according to the EU index as in Kabat. In one embodiment, the IgG1 comprises the amino acid substitutions G236A, S239D, and I332E wherein the amino acid residues are numbered according to the EU index as in Kabat. In one embodiment, the IgG1 comprises the amino acid substitutions K326A and E333A wherein the amino acid residues are numbered according to the EU index as in Kabat. In one embodiment, the IgG1 comprises the amino acid substitutions K326W and E333S wherein the amino acid residues are numbered according to the EU index as in Kabat. In one embodiment, the IgG1 comprises the amino acid substitutions K290E, S298G, T299A, with or without K326E wherein the amino acid residues are numbered according to the EU index as in Kabat. In one embodiment, the IgG1 comprises the amino acid substitutions K290N, S298G, T299A, with or without K326E wherein the amino acid residues are numbered according to the EU index as in Kabat. In one embodiment, the IgG1 comprises the amino acid substitution K334V wherein the amino acid residues are numbered according to the EU index as in Kabat. In one embodiment, the IgG1 comprises the amino acid substitutions L235S, S239D, and K334V wherein the amino acid residues are numbered according to the EU index as in Kabat. In one embodiment, the IgG1 comprises the amino acid substitutions K334V and Q331M, S239D, F243V, E294L, or S298T wherein the amino acid residues are numbered according to the EU index as in Kabat. In one embodiment, the IgG1 comprises the amino acid substitutions E233L, Q311M, and K334V wherein the amino acid residues are numbered according to the EU index as in Kabat. In one embodiment, the IgG1 comprises the amino acid substitutions L234I, Q311M, and K334V wherein the amino acid residues are numbered according to the EU index as in Kabat. In one embodiment, the IgG1 comprises the amino acid substitutions K334V and S298T, A330M, or A330F wherein the amino acid residues are numbered according to the EU index as in Kabat. In one embodiment, the IgG1 comprises the amino acid substitutions K334V, Q311M, and either A330M or A330F wherein the amino acid residues are numbered according to the EU index as in Kabat. In one embodiment, the IgG1 comprises the amino acid substitutions K334V, S298T, and either A330M or A330F wherein the amino acid residues are numbered according to the EU index as in Kabat. In one embodiment, the IgG1 comprises the amino acid substitutions K334V, S239D, and either A330M or S298T wherein the amino acid residues are numbered according to the EU index as in Kabat. In one embodiment, the IgG1 comprises the amino acid substitutions L234Y, Y296W, and K290Y, F243V, or E294L wherein the amino acid residues are numbered according to the EU index as in Kabat. In one embodiment, the IgG1 comprises the amino acid substitutions Y296W and either L234Y or K290Y wherein the amino acid residues are numbered according to the EU index as in Kabat. In one embodiment, the IgG1 comprises the amino acid substitutions S239D, A330S, and I332E wherein the amino acid residues are numbered according to the EU index as in Kabat.

In some embodiments, the IgG1 comprises one or more amino acid substitutions that decrease or inhibit effector function. In one embodiment, the IgG1 comprises the amino acid substitution N297A, N297G, or N297Q wherein the amino acid residues are numbered according to the EU index as in Kabat. In one embodiment, the IgG1 comprises the amino acid substitution L234A or L235A wherein the amino acid residues are numbered according to the EU index as in Kabat. In one embodiment, the IgG1 comprises the amino acid substitutions C220S, C226S, C229S, and P238S wherein the amino acid residues are numbered according to the EU index as in Kabat. In one embodiment, the IgG1 comprises the amino acid substitutions C226S, C229S, E233P, L234V, and L235A wherein the amino acid residues are numbered according to the EU index as in Kabat. In one embodiment, the IgG1 comprises the amino acid substitutions L234F, L235E, and P331S wherein the amino acid residues are numbered according to the EU index as in Kabat. In one embodiment, the IgG1 comprises the amino acid substitutions S267E and L328F wherein the amino acid residues are numbered according to the EU index as in Kabat.

In accordance with this description and the teachings of the art, it is contemplated that in some embodiments, an antibody or fragment thereof of the masked cytokine may comprise one or more alterations as compared to the wild type counterpart antibody, e.g. in the Fc region. For example, it is thought that certain alterations can be made in the Fc region that would result in altered (i.e., either improved or diminished) C1q binding and/or Complement Dependent Cytotoxicity (CDC), e.g., as described in WO99/51642. See also Duncan & Winter Nature 322:738-40 (1988); U.S. Pat. Nos. 5,648,260; 5,624,821; and WO94/29351 concerning other examples of Fc region variants. WO00/42072 (Presta) and WO 2004/056312 (Lowman) describe antibody variants with improved or diminished binding to FcRs. The content of these patent publications are specifically incorporated herein by reference. See also Shields et al. J. Biol. Chem. 9(2): 6591-6604 (2001). Antibodies with increased half-lives and improved binding to the neonatal Fc receptor (FcRn), which is responsible for the transfer of maternal IgGs to the fetus (Guyer et al., J. Immunol. 117:587 (1976) and Kim et al., J. Immunol. 24:249 (1994)), are described in US2005/0014934A1 (Hinton et al.). These antibodies comprise an Fc region with one or more substitutions therein which improve binding of the Fc region to FcRn. Polypeptide variants with altered Fc region amino acid sequences and increased or decreased C1q binding capability are described in U.S. Pat. No. 6,194,551B1, WO99/51642. The contents of those patent publications are specifically incorporated herein by reference. See, also, Idusogie et al. J. Immunol. 164: 4178-4184 (2000).

B. Masked Cytokine-Drug Conjugates

The invention also provides masked cytokine-drug conjugates (MCDCs) comprising a masked cytokine provided herein, which can be any masked cytokine disclosed herein, conjugated to one or more agents. In some embodiments, the one or more agents is a cytotoxic agent, such as a chemotherapeutic agent or drug, growth inhibitory agent, toxin (e.g., protein toxin, enzymatically active toxin of bacterial, fungal, plant, or animal origin, or fragments thereof), or radioactive isotopes. In some embodiments, the one or more agents is an immune stimulant.

In some embodiments, the one or more drugs conjugated to the masked cytokine includes, but is not limited to, a maytansinoid (see U.S. Pat. Nos. 5,208,020, 5,416,064 and European Patent EP 0 425 235 B1); an auristatin such as monomethylauristatin drug moieties DE and DF (MMAE and MMAF) (see U.S. Pat. Nos. 5,635,483 and 5,780,588, and 7,498,298); a dolastatin; a calicheamicin or derivative thereof (see U.S. Pat. Nos. 5,712,374, 5,714,586, 5,739,116, 5,767,285, 5,770,701, 5,770,710, 5,773,001, and 5,877,296; Hinman et al., Cancer Res. 53:3336-3342 (1993); and Lode et al., Cancer Res. 58:2925-2928 (1998)); an anthracycline such as daunomycin or doxorubicin (see Kratz et al., Current Med. Chem. 13:477-523 (2006); Jeffrey et al., Bioorganic & Med. Chem. Letters 16:358-362 (2006); Torgov et al., Bioconj. Chem. 16:717-721 (2005); Nagy et al., Proc. Natl. Acad. Sci. USA 97:829-834 (2000); Dubowchik et al., Bioorg. & Med. Chem. Letters 12:1529-1532 (2002); King et al., J. Med. Chem. 45:4336-4343 (2002); and U.S. Pat. No. 6,630,579); methotrexate; vindesine; a taxane such as docetaxel, paclitaxel, larotaxel, tesetaxel, and ortataxel; a trichothecene; and CC1065.

In another embodiment, the one or more drugs conjugated to the masked cytokine includes, but is not limited to, an inhibitor of tubulin polymerization (e.g., maytansinoids and auristatins), DNA damaging agents (e.g., pyrrolobenzodiazepine (PBD) dimers, calicheamicins, duocarmycins and indo-linobenzodiazepine dimers), and DNA synthesis inhibitors (e.g., exatecan derivative Dxd).

In another embodiment, a masked cytokine-drug conjugate comprises a masked cytokine as described herein conjugated to an enzymatically active toxin or fragment thereof, including, but not limited to, diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes.

In another embodiment, a masked cytokine-drug conjugate comprises a masked cytokine as described herein conjugated to a radioactive atom to form a radioconjugate. A variety of radioactive isotopes are available for the production of radioconjugates. Examples include At211, I131, I125, Y90, Re186, Re188, Sm153, Bi212, P32, Pb212 and radioactive isotopes of Lu. When the radioconjugate is used for detection, it may comprise a radioactive atom for scintigraphic studies, for example tc99m or I123, or a spin label for nuclear magnetic resonance (NMR) imaging (also known as magnetic resonance imaging, mri), such as iodine-123 again, iodine-131, indium-111, fluorine-19, carbon-13, nitrogen-15, oxygen-17, gadolinium, manganese or iron.

In some embodiments, a masked cytokine-drug conjugate comprises a masked cytokine as described herein conjugated to one or more immune stimulants. In some embodiments, the immune stimulant is a stimulator of interferon genes (STING) agonist or a toll-like receptor (TLR) agonist.

The STING agonist can be any agonist of STING. In some embodiments, the STING agonist is a cyclic dinucleotide (CDN). The CDN can be any CDN or derivative or variant thereof. In some embodiments, the STING agonist is a CDN selected from the group consisting of cGAMP, c-di-AMP, c-di-GMP, cAIMP, and c-di-IMP. In some embodiments, the STING agonist is a derivative or variant of a CDN selected from the group consisting of cGAMP, c-di-AMP, c-di-GMP, cAIMP, and c-di-IMP. In some embodiments, the STING agonist is 4-(2-chloro-6-fluorobenzyl)-N-(furan-2-ylmethyl)-3-oxo-3,4-dihydro-2H-benzo[b][1,4]thiazine-6-carboxamide, or a derivative or variant thereof. See, e.g., Sali et al. (2015) PloS Pathog., 11(12): e1005324.

The TLR agonist can be an agonist of any TLR, such as TLR1, TLR2, TLR3, TLR4, TLR5, TLR6, TLR7, TLR8, TLR9, or TLR10. In some embodiments, the TLR agonist is an agonist of a TLR expressed on the cell surface, such as TLR1, TLR2, TLR4, or TLR5. In some embodiments, the TLR agonist is an agonist of a TLR expressed intracellularly, such as TLR3, TLR7, TLR8, TLR9, or TLR10.

Conjugates of a masked cytokine and a cytotoxic agent may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., Science 238:1098 (1987). Carbon-14-labeled 1-isothiocyanatobenzyl-3-methyldiethylene triaminepentaacetic acid (MX-DTPA) is an exemplary chelating agent for conjugation of radionucleotide to an antibody. See WO94/11026. The linker may be a "cleavable linker" facilitating release of a cytotoxic drug in the cell. For example, an acid-labile linker, peptidase-sensitive linker, photolabile linker, dimethyl linker or disulfide-containing linker (Chari et al., Cancer Res. 52:127-131 (1992); U.S. Pat. No. 5,208,020) may be used.

The MCDCs herein expressly contemplate, but are not limited to such conjugates prepared with cross-linker reagents including, but not limited to, BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, Ill., U.S.A).

C. Vectors, Host Cells, and Recombinant Methods

For recombinant production of a masked cytokine of the invention, the one or more nucleic acids encoding it is isolated and inserted into a replicable vector for further cloning (amplification of the DNA) or for expression. DNA encoding the masked cytokine, including components thereof, is readily isolated and sequenced using conventional procedures. Many vectors are available. The choice of vector depends in part on the host cell to be used. Generally, host cells are of either prokaryotic or eukaryotic (generally mammalian) origin. It will be appreciated that constant regions of any isotype of antibody or fragment thereof, when applicable, can be used for this purpose, including IgG, IgM, IgA, IgD, and IgE constant regions, and that such constant regions can be obtained from any human or animal species. In some embodiments, one vector is used to encode the masked cytokine. In some embodiments, more than one vector is used to encode the masked cytokine.

1. Generating Masked Cytokines Using Prokaryotic Host Cells a. Vector Construction Polynucleotide sequences encoding polypeptide components of the masked cytokines of the invention can be obtained using standard recombinant techniques. Desired polynucleotide sequences of an antibody or antibody fragment thereof may be isolated and sequenced from antibody producing cells such as hybridoma cells. Alternatively, polynucleotides can be synthesized using nucleotide synthesizer or PCR techniques, or obtained from other sources. Once obtained, sequences encoding the components of the masked cytokine are inserted into a recombinant vector capable of replicating and expressing heterologous polynucleotides in prokaryotic hosts. Many vectors that are available and known in the art can be used for the purpose of the present invention. Selection of an appropriate vector will depend mainly on the size of the nucleic acids to be inserted into the vector and the particular host cell to be transformed with the vector. Each vector contains various components, depending on its function (amplification or expression of heterologous polynucleotide, or both) and its compatibility with the particular host cell in which it resides. The vector components generally include, but are not limited to: an origin of replication, a selection marker gene, a promoter, a ribosome binding site (RBS), a signal sequence, the heterologous nucleic acid insert and a transcription termination sequence.

In general, plasmid vectors containing replicon and control sequences which are derived from species compatible with the host cell are used in connection with these hosts. The vector ordinarily carries a replication site, as well as marking sequences which are capable of providing phenotypic selection in transformed cells. For example, E. coli is typically transformed using pBR322, a plasmid derived from an E. coli species. pBR322 contains genes-encoding ampicillin (Amp) and tetracycline (Tet) resistance and thus provides easy means for identifying transformed cells. pBR322, its derivatives, or other microbial plasmids or bacteriophage may also contain, or be modified to contain, promoters which can be used by the microbial organism for expression of endogenous proteins. Examples of pBR322 derivatives used for expression of particular antibodies are described in detail in Carter et al., U.S. Pat. No. 5,648,237.

In addition, phage vectors containing replicon and control sequences that are compatible with the host microorganism can be used as transforming vectors in connection with these hosts. For example, bacteriophage such as λGEM™-11 may be utilized in making a recombinant vector which can be used to transform susceptible host cells such as E. coli LE392.

The expression vector of the invention may comprise two or more promoter-cistron pairs, encoding each of the polypeptide components. A promoter is an untranslated regulatory sequence located upstream (5') to a cistron that modulates its expression. Prokaryotic promoters typically fall into two classes, inducible and constitutive. Inducible promoter is a promoter that initiates increased levels of transcription of the cistron under its control in response to changes in the culture condition, e.g. the presence or absence of a nutrient or a change in temperature.

A large number of promoters recognized by a variety of potential host cells are well known. The selected promoter can be operably linked to cistron DNA encoding either chain of the masked cytokine by removing the promoter from the source DNA via restriction enzyme digestion and inserting the isolated promoter sequence into the vector of the invention. Both the native promoter sequence and many heterologous promoters may be used to direct amplification and/or expression of the target genes. In some embodiments, heterologous promoters are utilized, as they generally permit greater transcription and higher yields of expressed target gene as compared to the native target polypeptide promoter.

Promoters suitable for use with prokaryotic hosts include the PhoA promoter, the β-galactamase and lactose promoter systems, a tryptophan (trp) promoter system and hybrid promoters such as the tac or the trc promoter. However, other promoters that are functional in bacteria (such as other known bacterial or phage promoters) are suitable as well. Their nucleotide sequences have been published, thereby enabling a skilled worker operably to ligate them to cistrons encoding, for example, the target light and heavy chains for masked cytokines comprising a light and heavy chain (Siebenlist et al. (1980) Cell 20: 269) using linkers or adaptors to supply any required restriction sites.

In one aspect of the invention, each cistron within the recombinant vector comprises a secretion signal sequence component that directs translocation of the expressed polypeptides across a membrane. In general, the signal sequence may be a component of the vector, or it may be a part of the target polypeptide DNA that is inserted into the vector. The signal sequence selected for the purpose of this invention should be one that is recognized and processed (i.e. cleaved by a signal peptidase) by the host cell. For prokaryotic host cells that do not recognize and process the signal sequences native to the heterologous polypeptides, the signal sequence is substituted by a prokaryotic signal sequence selected, for example, from the group consisting of the alkaline phosphatase, penicillinase, Ipp, or heat-stable enterotoxin II (STII) leaders, LamB, PhoE, PelB, OmpA and MBP. In one embodiment of the invention, the signal sequences used in both cistrons of the expression system are STII signal sequences or variants thereof.

In another aspect, the production of the polypeptide components according to the invention can occur in the cytoplasm of the host cell, and therefore does not require the presence of secretion signal sequences within each cistron. In that regard, for embodiments comprising immunoglobulin light and heavy chains, for example, the light and heavy chains are expressed with or without the sequences for the masking moiety, linker sequence, etc., folded and assembled to form functional immunoglobulins within the cytoplasm. Certain host strains (e.g., the *E. coli* trxB-strains) provide cytoplasm conditions that are favorable for disulfide bond formation, thereby permitting proper folding and assembly of expressed protein subunits. Proba and Pluckthun Gene, 159:203 (1995).

Masked cytokines of the invention can also be produced by using an expression system in which the quantitative ratio of expressed polypeptide components can be modulated in order to maximize the yield of secreted and properly assembled antibodies of the invention. Such modulation is accomplished at least in part by simultaneously modulating translational strengths for the polypeptide components.

Prokaryotic host cells suitable for expressing masked cytokines of the invention include *Archaebacteria* and *Eubacteria*, such as Gram-negative or Gram-positive organisms. Examples of useful bacteria include *Escherichia* (e.g., *E. coli*), *Bacilli* (e.g., *B. subtilis*), *Enterobacteria*, *Pseudomonas* species (e.g., *P. aeruginosa*), *Salmonella typhimurium*, *Serratia marcescans*, *Klebsiella*, *Proteus*, *Shigella*, *Rhizobia*, *Vitreoscilla*, or *Paracoccus*. In one embodiment, gram-negative cells are used. In one embodiment, *E. coli* cells are used as hosts for the invention. Examples of *E. coli* strains include strain W3110 (Bachmann, Cellular and Molecular Biology, vol. 2 (Washington, D.C.: American Society for Microbiology, 1987), pp. 1190-1219; ATCC Deposit No. 27,325) and derivatives thereof, including strain 33D3 having genotype W3110 ΔfhuA (ΔtonA) ptr3 lac Iq lacL8 ΔompTΔ(nmpc-fepE) degP41 kanR (U.S. Pat. No. 5,639,635). Other strains and derivatives thereof, such as *E. coli* 294 (ATCC 31,446), *E. coli* B, *E. coli*λ 1776 (ATCC 31,537) and *E. coli* RV308(ATCC 31,608) are also suitable. These examples are illustrative rather than limiting. Methods for constructing derivatives of any of the above-mentioned bacteria having defined genotypes are known in the art and described in, for example, Bass et al., Proteins, 8:309-314 (1990). It is generally necessary to select the appropriate bacteria taking into consideration replicability of the replicon in the cells of a bacterium. For example, *E. coli*, *Serratia*, or *Salmonella* species can be suitably used as the host when well-known plasmids such as pBR322, pBR325, pACYC177, or pKN410 are used to supply the replicon. Typically, the host cell should secrete minimal amounts of proteolytic enzymes, and additional protease inhibitors may desirably be incorporated in the cell culture.

b. Masked Cytokine Production

Host cells are transformed with the above-described expression vectors and cultured in conventional nutrient media modified as appropriate for inducing promoters, selecting transformants, or amplifying the genes encoding the desired sequences.

Transformation means introducing DNA into the prokaryotic host so that the DNA is replicable, either as an extrachromosomal element or by chromosomal integrant. Depending on the host cell used, transformation is done using standard techniques appropriate to such cells. The calcium treatment employing calcium chloride is generally used for bacterial cells that contain substantial cell-wall barriers. Another method for transformation employs polyethylene glycol/DMSO. Yet another technique used is electroporation.

Prokaryotic cells used to produce the masked cytokines of the invention are grown in media known in the art and suitable for culture of the selected host cells. Examples of suitable media include luria broth (LB) plus necessary nutrient supplements. In some embodiments, the media also contains a selection agent, chosen based on the construction of the expression vector, to selectively permit growth of prokaryotic cells containing the expression vector. For example, ampicillin is added to media for growth of cells expressing ampicillin resistant gene.

Any necessary supplements besides carbon, nitrogen, and inorganic phosphate sources may also be included at appropriate concentrations introduced alone or as a mixture with another supplement or medium such as a complex nitrogen source. Optionally, the culture medium may contain one or more reducing agents selected from the group consisting of glutathione, cysteine, cystamine, thioglycollate, dithioerythritol and dithiothreitol.

The prokaryotic host cells are cultured at suitable temperatures. In certain embodiments, for *E. coli* growth, growth temperatures range from about 20° C. to about 39° C.; from about 25° C. to about 37° C.; or about 30° C. The pH of the medium may be any pH ranging from about 5 to about 9, depending mainly on the host organism. In certain embodiments, for *E. coli*, the pH is from about 6.8 to about 7.4, or about 7.0.

If an inducible promoter is used in the expression vector of the invention, protein expression is induced under conditions suitable for the activation of the promoter. In one aspect of the invention, PhoA promoters are used for controlling transcription of the polypeptides. Accordingly, the transformed host cells are cultured in a phosphate-limiting medium for induction. In certain embodiments, the phosphate-limiting medium is the C.R.A.P. medium (see, e.g., Simmons et al., J. Immunol. Methods (2002), 263:133-147). A variety of other inducers may be used, according to the vector construct employed, as is known in the art.

In one embodiment, the expressed masked cytokines of the present invention are secreted into and recovered from the periplasm of the host cells. Protein recovery typically involves disrupting the microorganism, generally by such means as osmotic shock, sonication or lysis. Once cells are disrupted, cell debris or whole cells may be removed by centrifugation or filtration. The proteins may be further purified, for example, by affinity resin chromatography. Alternatively, proteins can be transported into the culture media and isolated therein. Cells may be removed from the culture and the culture supernatant being filtered and concentrated for further purification of the proteins produced. The expressed polypeptides can be further isolated and identified using commonly known methods such as polyacrylamide gel electrophoresis (PAGE) and Western blot assay.

In one aspect of the invention, masked cytokine production is conducted in large quantity by a fermentation process. Various large-scale fed-batch fermentation procedures are available for production of recombinant proteins. Large-scale fermentations have at least 1000 liters of capacity, and in certain embodiments, about 1,000 to 100,000 liters of capacity. These fermentors use agitator impellers to distribute oxygen and nutrients, especially glucose Small scale fermentation refers generally to fermentation in a fermentor that is no more than approximately 100 liters in volumetric capacity, and can range from about 1 liter to about 100 liters.

In a fermentation process, induction of protein expression is typically initiated after the cells have been grown under suitable conditions to a desired density, e.g., an OD550 of about 180-220, at which stage the cells are in the early stationary phase. A variety of inducers may be used, according to the vector construct employed, as is known in the art and described above. Cells may be grown for shorter periods prior to induction. Cells are usually induced for about 12-50 hours, although longer or shorter induction time may be used.

To improve the production yield and quality of the polypeptides of the invention, various fermentation conditions can be modified. For example, to improve the proper assembly and folding of, for example, secreted antibody polypeptides, additional vectors overexpressing chaperone proteins, such as Dsb proteins (DsbA, DsbB, DsbC, DsbD and or DsbG) or FkpA (a peptidylprolyl cis,trans-isomerase with chaperone activity) can be used to co-transform the host prokaryotic cells. The chaperone proteins have been demonstrated to facilitate the proper folding and solubility of heterologous proteins produced in bacterial host cells. Chen et al. (1999) J. Biol. Chem. 274:19601-19605; Georgiou et al., U.S. Pat. No. 6,083,715; Georgiou et al., U.S. Pat. No. 6,027,888; Bothmann and Pluckthun (2000) J. Biol. Chem. 275:17100-17105; Ramm and Pluckthun (2000) J. Biol. Chem. 275:17106-17113; Arie et al. (2001) Mol. Microbiol. 39:199-210.

To minimize proteolysis of expressed heterologous proteins (especially those that are proteolytically sensitive), certain host strains deficient for proteolytic enzymes can be used for the present invention. For example, host cell strains may be modified to effect genetic mutation(s) in the genes encoding known bacterial proteases such as Protease III, OmpT, DegP, Tsp, Protease I, Protease Mi, Protease V, Protease VI and combinations thereof. Some *E. coli* protease-deficient strains are available and described in, for example, Joly et al. (1998), supra; Georgiou et al., U.S. Pat. No. 5,264,365; Georgiou et al., U.S. Pat. No. 5,508,192; Hara et al., Microbial Drug Resistance, 2:63-72 (1996).

In some embodiments, *E. coli* strains deficient for proteolytic enzymes and transformed with plasmids overexpressing one or more chaperone proteins are used as host cells in the expression system of the invention.

c. Masked Cytokine Purification

In some embodiments, the masked cytokine produced herein is further purified to obtain preparations that are substantially homogeneous for further assays and uses. Standard protein purification methods known in the art can be employed. The following procedures are exemplary of suitable purification procedures: fractionation on immunoaffinity or ion-exchange columns, ethanol precipitation, reverse phase HPLC, chromatography on silica or on a cation-exchange resin such as DEAE, chromatofocusing, SDS-PAGE, ammonium sulfate precipitation, and gel filtration using, for example, Sephadex G-75.

In some embodiments, Protein A immobilized on a solid phase is used for immunoaffinity purification of the masked cytokines of the invention. Protein A is a 41 kD cell wall protein from *Staphylococcus aureas* which binds with a high affinity to the Fc region of antibodies. Lindmark et al (1983) J. Immunol. Meth. 62:1-13. The solid phase to which Protein A is immobilized can be a column comprising a glass or silica surface, or a controlled pore glass column or a silicic acid column. In some applications, the column is coated with a reagent, such as glycerol, to possibly prevent nonspecific adherence of contaminants.

As the first step of purification, a preparation derived from the cell culture as described above can be applied onto a Protein A immobilized solid phase to allow specific binding of the masked cytokine of interest to Protein A. The solid phase would then be washed to remove contaminants nonspecifically bound to the solid phase. Finally, the masked cytokine of interest is recovered from the solid phase by elution.

Other methods of purification that provide for high affinity binding to a component of the masked cytokine can be employed in accordance with standard protein purification methods known in the art.

2. Generating Masked Cytokines Using Eukaryotic Host Cells

A vector for use in a eukaryotic host cell generally includes one or more of the following non-limiting components: a signal sequence, an origin of replication, one or more marker genes, an enhancer element, a promoter, and a transcription termination sequence.

a. Signal Sequence Component

A vector for use in a eukaryotic host cell may also contain a signal sequence or other polypeptide having a specific cleavage site at the N-terminus of the mature protein or polypeptide of interest. The heterologous signal sequence selected may be one that is recognized and processed (i.e., cleaved by a signal peptidase) by the host cell. In mammalian cell expression, mammalian signal sequences as well as viral secretory leaders, for example, the herpes simplex gD signal, are available. The DNA for such a precursor region is ligated in reading frame to DNA encoding the masked cytokine.

b. Origin of Replication

Generally, an origin of replication component is not needed for mammalian expression vectors. For example, the SV40 origin may typically be used only because it contains the early promoter.

c. Selection Gene Component

Expression and cloning vectors may contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, where relevant, or (c) supply critical nutrients not available from complex media.

One example of a selection scheme utilizes a drug to arrest growth of a host cell. Those cells that are successfully transformed with a heterologous gene produce a protein conferring drug resistance and thus survive the selection regimen. Examples of such dominant selection use the drugs neomycin, mycophenolic acid and hygromycin.

Another example of suitable selectable markers for mammalian cells are those that enable the identification of cells competent to take up the masked cytokine encoding nucleic acid, such as DHFR, thymidine kinase, metallothionein-I and -II, primate metallothionein genes, adenosine deaminase, ornithine decarboxylase, etc.

For example, in some embodiments, cells transformed with the DHFR selection gene are first identified by culturing all of the transformants in a culture medium that contains methotrexate (Mtx), a competitive antagonist of DHFR. In some embodiments, an appropriate host cell when wild-type DHFR is employed is the Chinese hamster ovary (CHO) cell line deficient in DHFR activity (e.g., ATCC CRL-9096).

Alternatively, host cells (particularly wild-type hosts that contain endogenous DHFR) transformed or co-transformed with DNA sequences encoding a masked cytokine, wild-type DHFR protein, and another selectable marker such as aminoglycoside 3'-phosphotransferase (APH) can be selected by cell growth in medium containing a selection agent for the selectable marker such as an aminoglycosidic antibiotic, e.g., kanamycin, neomycin, or G418. See U.S. Pat. No. 4,965,199. Host cells may include NS0, including cell lines deficient in glutamine synthetase (GS). Methods for the use of GS as a selectable marker for mammalian cells are described in U.S. Pat. Nos. 5,122,464 and 5,891,693.

d. Promoter Component

Expression and cloning vectors usually contain a promoter that is recognized by the host organism and is operably linked to nucleic acid encoding a masked cytokine of interest, which can be any masked cytokine described herein. Promoter sequences are known for eukaryotes. For example, virtually all eukaryotic genes have an AT-rich region located approximately 25 to 30 bases upstream from the site where transcription is initiated. Another sequence found 70 to 80 bases upstream from the start of transcription of many genes is a CNCAAT region where N may be any nucleotide. At the 3' end of most eukaryotic genes is an AATAAA sequence that may be the signal for addition of the poly A tail to the 3' end of the coding sequence. In certain embodiments, any or all of these sequences may be suitably inserted into eukaryotic expression vectors.

Transcription from vectors in mammalian host cells is controlled, for example, by promoters obtained from the genomes of viruses such as polyoma virus, fowlpox virus, adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, from heat-shock promoters, provided such promoters are compatible with the host cell systems.

The early and late promoters of the SV40 virus are conveniently obtained as an SV40 restriction fragment that also contains the SV40 viral origin of replication. The immediate early promoter of the human cytomegalovirus is conveniently obtained as a HindIII E restriction fragment. A system for expressing DNA in mammalian hosts using the bovine papilloma virus as a vector is disclosed in U.S. Pat. No. 4,419,446. A modification of this system is described in U.S. Pat. No. 4,601,978. See also Reyes et al., Nature 297:598-601 (1982), describing expression of human β-interferon cDNA in murine cells under the control of a thymidine kinase promoter from herpes simplex virus. Alternatively, the Rous Sarcoma Virus long terminal repeat can be used as the promoter.

e. Enhancer Element Component

Transcription of DNA encoding a masked cytokine of this invention by higher eukaryotes is often increased by inserting an enhancer sequence into the vector. Many enhancer sequences are now known from mammalian genes (globin, elastase, albumin, a-fetoprotein, and insulin). Typically, however, one will use an enhancer from a eukaryotic cell virus. Examples include the SV40 enhancer on the late side of the replication origin (bp 100-270), the human cytomegalovirus early promoter enhancer, the murine cytomegalovirus early promoter enhancer, the polyoma enhancer on the late side of the replication origin, and adenovirus enhancers. See also Yaniv, Nature 297:17-18 (1982) (describing enhancer elements for activation of eukaryotic promoters). The enhancer may be spliced into the vector at a position 5' or 3' to the masked cytokine-encoding sequence, but is generally located at a site 5' from the promoter.

f. Transcription Termination Component

Expression vectors used in eukaryotic host cells may also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding a masked cytokine. One useful transcription termination component is the bovine growth hormone polyadenylation region. See WO94/11026 and the expression vector disclosed therein.

g. Selection and Transformation of Host Cells

Suitable host cells for cloning or expressing the DNA in the vectors herein include higher eukaryote cells described herein, including vertebrate host cells. Propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36:59 (1977)); baby hamster kidney cells (BHK, ATCC CCL 10); Chinese hamster ovary cells/-DHFR (CHO, Urlaub et al., Proc. Natl. Acad. Sci. USA 77:4216 (1980)); murine sertoli cells (TM4, Mather, Biol. Reprod. 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); murine mammary tumor (MMT 060562, ATCC CCL51); TRI cells (Mather et al., Annals N.Y. Acad. Sci. 383:44-68 (1982)); MRC 5 cells; FS4 cells; and a human hepatoma line (Hep G2).

Host cells are transformed with the above-described-expression or cloning vectors for masked cytokine production and cultured in conventional nutrient media modified as appropriate for inducing promoters, selecting transformants, or amplifying the genes encoding the desired sequences.

h. Culturing Host Cells

The host cells used to produce masked cytokines of this invention may be cultured in a variety of media. Commercially available media such as Ham's F10 (Sigma), Minimal Essential Medium ((MEM), Sigma), RPMI-1640 (Sigma), and Dulbecco's Modified Eagle's Medium ((DMEM), Sigma) are suitable for culturing the host cells. In addition, any of the media described in Ham et al., Meth. Enz. 58:44 (1979), Barnes et al., Anal. Biochem. 102:255 (1980), U.S. Pat. No. 4,767,704; 4,657,866; 4,927,762; 4,560,655; or 5,122,469; WO 90/03430; WO 87/00195; or U.S. Pat. Re. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™ drug), trace elements (defined as inorganic compounds usually present at final concentrations in the micromolar range), and glucose or an equivalent energy source. Any other supplements may also be included at appropriate concentrations that would be known to those skilled in the art. The culture conditions, such as temperature, pH, and the like, are those previously used with the host cell selected for expression, and will be apparent to the ordinarily skilled artisan.

i. Purification of Masked Cytokines

When using recombinant techniques, the masked cytokines can be produced intracellularly, or directly secreted into the medium. If the masked cytokine is produced intracellularly, as a first step, the particulate debris, either host cells or lysed fragments, may be removed, for example, by centrifugation or ultrafiltration. Where the masked cytokine is secreted into the medium, supernatants from such expression systems may be first concentrated using a commercially available protein concentration filter, for example, an Amicon or Millipore Pellicon ultrafiltration unit. A protease inhibitor such as PMSF may be included in any of the foregoing steps to inhibit proteolysis, and antibiotics may be included to prevent the growth of adventitious contaminants.

The masked cytokine composition prepared from the cells can be purified using, for example, hydroxylapatite chromatography, gel electrophoresis, dialysis, and affinity chromatography, with affinity chromatography being a convenient technique. The suitability of protein A as an affinity ligand depends on the species and isotype of any immunoglobulin Fc domain, if any, that is present in the masked cytokine. Protein A can be used to purify antibodies that are based on human IgG1, IgG2, or IgG4 heavy chains (Lindmark et al., J. Immunol. Methods 62:1-13 (1983)). Protein G is recommended for all murine isotypes and for human γ3 (Guss et al., EMBO J. 5:15671575 (1986)). The matrix to which the affinity ligand is attached may be agarose, but other matrices are available. Mechanically stable matrices such as controlled pore glass or poly(styrenedivinyl)benzene allow for faster flow rates and shorter processing times than can be achieved with agarose. Where the masked cytokine comprises a CH3 domain, the Bakerbond ABX™ resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the masked cytokine to be recovered.

Following any preliminary purification step(s), the mixture comprising the masked cytokine of interest and contaminants may be subjected to further purification, for example, by low pH hydrophobic interaction chromatography using an elution buffer at a pH between about 2.5-4.5, performed at low salt concentrations (e.g., from about 0-0.25M salt).

In general, various methodologies for preparing masked cytokines for use in research, testing, and clinical use are well-established in the art, consistent with the above-described methodologies and/or as deemed appropriate by one skilled in the art for a particular masked cytokine of interest.

III. COMPOSITIONS

In some aspects, also provided herein are compositions comprising any of the masked cytokines described herein. In some embodiments, the composition comprises any of the exemplary embodiments of masked cytokine described herein. In some embodiments, the composition comprises a dimer of any of the masked cytokines described herein. In some embodiments, the composition is a pharmaceutical composition. In some embodiments, the composition comprises a masked cytokine and further comprises one or more of the components as described in detail below. For example, in some embodiments, the composition comprises one or more pharmaceutically acceptable carriers, excipients, stabilizers, buffers, preservatives, tonicity agents, non-ionic surfactants or detergents, or other therapeutic agents or active compounds, or combinations thereof. The various embodiments of the composition are sometimes referred to herein as formulations.

Therapeutic formulations are prepared for storage by mixing the active ingredient having the desired degree of purity with optional pharmaceutically acceptable carriers, excipients or stabilizers (Remington: The Science and Practice of Pharmacy, 20th Ed., Lippincott Williams & Wiklins, Pub., Gennaro Ed., Philadelphia, Pa. 2000). Acceptable carriers, excipients, or stabilizers are nontoxic to recipients at the dosages and concentrations employed, and include buffers, antioxidants including ascorbic acid, methionine, Vitamin E, sodium metabisulfite; preservatives, isotonicifiers, stabilizers, metal complexes (e.g. Zn-protein complexes); chelating agents such as EDTA and/or non-ionic surfactants.

Buffers can be used to control the pH in a range which optimizes the therapeutic effectiveness, especially if stability is pH dependent. Buffers can be present at concentrations ranging from about 50 mM to about 250 mM. Suitable buffering agents for use with the present invention include both organic and inorganic acids and salts thereof. For example, citrate, phosphate, succinate, tartrate, fumarate, gluconate, oxalate, lactate, acetate. Additionally, buffers may be comprised of histidine and trimethylamine salts such as Tris.

Preservatives can be added to prevent microbial growth, and are typically present in a range from about 0.2%-1.0% (w/v). Examples of suitable preservatives commonly used with therapeutics include octadecyldimethylbenzyl ammonium chloride; hexamethonium chloride; benzalkonium halides (e.g., chloride, bromide, iodide), benzethonium chloride; thimerosal, phenol, butyl or benzyl alcohol; alkyl parabens such as methyl or propyl paraben; catechol; resorcinol; cyclohexanol, 3-pentanol, m-cresol, o-cresol, p-cresol, methyl p-hydroxybenzoate, propyl p-hydroxybenzoate, 2-phenoxyethanol, butyl p-hydroxybenzoate, 2-phenylethanol, ethanol, chlorobutanol, thiomerosal, bronopol, benzoic acid, imidurea, chlorohexidine, sodium dehydroacetate, chlorocresol, ethyl p-hydroxybenzoate, and chlorphenesine (3p-chlrphenoxypropane-1,2-diol).

Tonicity agents, sometimes known as "stabilizers" can be present to adjust or maintain the tonicity of liquid in a composition. When used with large, charged biomolecules such as proteins and antibodies, they are often termed "stabilizers" because they can interact with the charged groups of the amino acid side chains, thereby lessening the potential for inter and intra-molecular interactions. Tonicity agents can be present in any amount between about 0.1% to about 25% by weight or between about 1 to about 5% by weight, taking into account the relative amounts of the other ingredients. In some embodiments, tonicity agents include polyhydric sugar alcohols, trihydric or higher sugar alcohols, such as glycerin, erythritol, arabitol, xylitol, sorbitol and mannitol.

Additional excipients include agents which can serve as one or more of the following: (1) bulking agents, (2) solubility enhancers, (3) stabilizers and (4) and agents preventing denaturation or adherence to the container wall. Such excipients include: polyhydric sugar alcohols (enumerated above); amino acids such as alanine, glycine, glutamine, asparagine, histidine, arginine, lysine, ornithine, leucine, 2-phenylalanine, glutamic acid, threonine, etc.; organic sugars or sugar alcohols such as sucrose, lactose, lactitol, trehalose, stachyose, mannose, sorbose, xylose, ribose, ribitol, myoinisitose, myoinisitol, galactose, galactitol, glycerol, cyclitols (e.g., inositol), polyethylene glycol; sulfur containing reducing agents, such as urea, glutathione, thioctic acid, sodium thioglycolate, thioglycerol, α-monothioglycerol and sodium thio sulfate; low molecular weight proteins such as human serum albumin, bovine serum albumin, gelatin or other immunoglobulins; hydrophilic polymers such as polyvinylpyrrolidone; monosaccharides (e.g., xylose, mannose, fructose, glucose; disaccharides (e.g., lactose, maltose, sucrose); trisaccharides such as raffinose; and polysaccharides such as dextrin or dextran.

Non-ionic surfactants or detergents (also known as "wetting agents") can be present to help solubilize the therapeutic agent as well as to protect the therapeutic protein against agitation-induced aggregation, which also permits the formulation to be exposed to shear surface stress without causing denaturation of the active therapeutic protein or antibody. Non-ionic surfactants are present in a range of about 0.05 mg/ml to about 1.0 mg/ml or about 0.07 mg/ml to about 0.2 mg/ml. In some embodiments, non-ionic surfactants are present in a range of about 0.001% to about 0.1% w/v or about 0.01% to about 0.1% w/v or about 0.01% to about 0.025% w/v.

Suitable non-ionic surfactants include polysorbates (20, 40, 60, 65, 80, etc.), polyoxamers (184, 188, etc.), PLURONIC® polyols, TRITON®, polyoxyethylene sorbitan monoethers (TWEEN®-20, TWEEN®-80, etc.), lauromacrogol 400, polyoxyl 40 stearate, polyoxyethylene hydrogenated castor oil 10, 50 and 60, glycerol monostearate, sucrose fatty acid ester, methyl celluose and carboxymethyl cellulose. Anionic detergents that can be used include sodium lauryl sulfate, dioctyle sodium sulfosuccinate and dioctyl sodium sulfonate. Cationic detergents include benzalkonium chloride or benzethonium chloride.

In order for the formulations to be used for in vivo administration, they must be sterile. The formulation may be rendered sterile by filtration through sterile filtration membranes. The therapeutic compositions herein generally are placed into a container having a sterile access port, for example, an intravenous solution bag or vial having a stopper pierceable by a hypodermic injection needle.

The route of administration is in accordance with known and accepted methods, such as by single or multiple bolus or infusion over a long period of time in a suitable manner, e.g., injection or infusion by subcutaneous, intravenous, intraperitoneal, intramuscular, intraarterial, intralesional or intraarticular routes, topical administration, inhalation or by sustained release or extended-release means.

Any of the masked cytokines described herein can be used alone or in combination with other therapeutic agents such is in the methods described herein. The term "in combination with" encompasses two or more therapeutic agents (e.g., a masked cytokine and a therapeutic agent) that are included in the same or separate formulations. In some embodiments, "in combination with" refers to "simultaneous" administration, in which case administration of the masked cytokine of the invention occurs simultaneously to the administration of the one or more additional therapeutic agents (e.g., at the same time or within one hour between administration(s) of the masked cytokine and administration of the one or more additional therapeutic agents). In some embodiments, "in combination with" refers to sequential administration, in which case administration of the masked cytokine of the invention occurs prior to and/or following, administration of the one or more additional therapeutic agents (e.g., greater than one hour between administration(s) of the masked cytokine and administration of the one or more additional therapeutic agents). Agents contemplated herein include, but are not limited to, a cytotoxic agent, a cytokine, an agent targeting an immune checkpoint molecule, an agent targeting an immune stimulatory molecule, a growth inhibitory agent, an immune stimulatory agent, an anti-inflammatory agent, or an anti-cancer agent.

The formulation herein may also contain more than one active compound as necessary for the particular indication being treated, preferably those with complementary activities that do not adversely affect each other. Alternatively, or in addition, the composition may comprise a cytotoxic agent, cytokine, agent targeting an immune checkpoint molecule or stimulatory molecule, growth inhibitory agent, an immune stimulatory agent, an anti-inflammatory agent, or an anti-cancer agent. Such molecules are suitably present in combination in amounts that are effective for the purpose intended.

The formulation may be presented in any suitable state, such as a liquid formulation, a solid state (lyophilized) formulation, or a frozen formulation. Approaches for preparing each of these types of formulations for therapeutic use are well known in the art.

IV. METHODS OF TREATMENT

Provided herein are methods for treating or preventing a disease in a subject comprising administering to the subject an effective amount of any masked cytokine described herein or compositions thereof. In some embodiments, methods are provided for treating or preventing a disease in a subject comprising administering to the subject an effective amount of a masked cytokine. In some embodiments, methods are provided for treating or preventing a disease in a subject comprising administering to the subject an effective amount of any embodiment of a masked cytokine described herein. In some embodiments, methods are provided for treating or preventing a disease in a subject comprising administering to the subject any composition described herein. In some embodiments, the subject (e.g., a human patient) has been diagnosed with a neoplastic disorder (e.g., cancer) or is at risk of developing such a disorder.

For the prevention or treatment of disease, the appropriate dosage of an active agent will depend on the type of disease to be treated, as defined herein, the severity and course of the disease, whether the agent is administered for preventive or therapeutic purposes, previous therapy, the subject's clinical history and response to the agent, and the discretion of the attending physician. The agent is suitably administered to the subject at one time or over a series of treatments.

In some embodiments of the methods described herein, an interval between administrations of a masked cytokine described herein is about one week or longer. In some embodiments of the methods described herein, an interval between administrations of a masked cytokine described herein is about two days or longer, about three days or longer, about four days or longer, about five days or longer, or about six days or longer. In some embodiments of the methods described herein, an interval between administrations of a masked cytokine described herein is about one week or longer, about two weeks or longer, about three weeks or longer, or about four weeks or longer. In some embodiments of the methods described herein, an interval between administrations of a masked cytokine described herein is about one month or longer, about two months or longer, or about three months or longer. As used herein, an interval between administrations refers to the time period between one administration of the masked cytokine and the next administration of the masked cytokine. As used herein, an interval of about one month includes four weeks. In some embodiments, the treatment includes multiple administrations of the masked cytokine, wherein the interval between administrations may vary. For example, in some embodiments, the interval between the first administration and the second administration is about one week, and the intervals between the subsequent administrations are about two weeks. In some embodiments, the interval between the first administration and the second administration is about two days, three days, four days, or five days, or six days, and the intervals between the subsequent administrations are about one week.

In some embodiments, the masked cytokine is administered on multiple occasions over a period of time. The dosage that is administered to the subject on multiple occasions can, in some embodiments, be the same dosage for each administration, or, in some embodiments, the masked cytokine can be administered to the subject at two or more different dosages. For example, in some embodiments, a masked cytokine is initially administered at one dosage on one or more occasions and is later administered at a second dosage on one or more occasions beginning at a later time point.

In some embodiments, a masked cytokine described herein is administered at a flat dose. In some embodiments, a masked cytokine described herein is administered to a subject at a dosage from about 25 mg to about 500 mg per dose. In some embodiments, the masked cytokine is administered to a subject at a dosage of about 25 mg to about 50 mg, about 50 mg to about 75 mg, about 75 mg to about 100 mg, about 100 mg to about 125 mg, about 125 mg to about 150 mg, about 150 mg to about 175 mg, about 175 mg to about 200 mg, about 200 mg to about 225 mg, about 225 mg to about 250 mg, about 250 mg to about 275 mg, about 275 mg to about 300 mg, about 300 mg to about 325 mg, about 325 mg to about 350 mg, about 350 mg to about 375 mg, about 375 mg to about 400 mg, about 400 mg to about 425 mg, about 425 mg to about 450 mg, about 450 mg, to about 475 mg, or about 475 mg to about 500 mg per dose.

In some embodiments, a masked cytokine described herein is administered to a subject at a dosage based on the subject's weight or body surface area (BSA). Depending on the type and severity of the disease, about 1 µg/kg to 15 mg/kg (e.g. 0.1 mg/kg-10 mg/kg) of masked cytokine can be an initial candidate dosage for administration to the patient, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. One exemplary dosage of the masked cytokine would be in the range from about 0.05 mg/kg to about 10 mg/kg. Thus, one or more doses of about 0.5 mg/kg, 2.0 mg/kg, 4.0 mg/kg or 10 mg/kg (or any combination thereof) may be administered to the patient. In some embodiments, a masked cytokine described herein is administered to a subject at a dosage from about 0.1 mg/kg to about 10 mg/kg or about 1.0 mg/kg to about 10 mg/kg. In some embodiments, a masked cytokine described herein is administered to a subject at a dosage of about any of 0.1 mg/kg, 0.5 mg/kg, 1.0 mg/kg, 1.5 mg/kg, 2.0 mg/kg, 2.5 mg/kg, 3.0 mg/kg, 3.5 mg/kg, 4.0 mg/kg, 4.5 mg/kg, 5.0 mg/kg, 5.5 mg/kg, 6.0 mg/kg, 6.5 mg/kg, 7.0 mg/kg, 7.5 mg/kg, 8.0 mg/kg, 8.5 mg/kg, 9.0 mg/kg, 9.5 mg/kg, or 10.0 mg/kg. In some embodiments, a masked cytokine described herein is administered to a subject at a dosage of about or at least about 0.1 mg/kg, about or at least about 0.5 mg/kg, about or at least about 1.0 mg/kg, about or at least about 1.5 mg/kg, about or at least about 2.0 mg/kg, about or at least about 2.5 mg/kg, about or at least about 3.0 mg/kg, about or at least about 3.5 mg/kg, about or at least about 4.0 mg/kg, about or at least about 4.5 mg/kg, about or at least about 5.0 mg/kg, about or at least about 5.5 mg/kg, about or at least about 6.0 mg/kg, about or at least about 6.5 mg/kg, about or at least about 7.0 mg/kg, about or at least about 7.5 mg/kg, about or at least about 8.0 mg/kg, about or at least about 8.5 mg/kg, about or at least about 9.0 mg/kg, about or at least about 9.5 mg/kg, about or at least about 10.0 mg/kg, about or at least about 15.0 mg/kg, about or at least about 20 mg/kg, about or at least about 30 mg/kg, about or at least about 40 mg/kg, about or at least about 50 mg/kg, about or at least about 60 mg/kg, about or at least about 70 mg/kg, about or at least about 80 mg/kg, about or at least about 90 mg/kg, or about or at least about 100 mg/kg. Any of the dosing frequencies described above may be used.

In some embodiments, a masked IL-2 polypeptide described herein is administered at a flat dose. In some embodiments, a masked IL-2 polypeptide described herein is administered to a subject at a dosage from about 25 mg to about 500 mg per dose. In some embodiments, the masked IL-2 polypeptide is administered to a subject at a dosage of about 25 mg to about 50 mg, about 50 mg to about 75 mg, about 75 mg to about 100 mg, about 100 mg to about 125 mg, about 125 mg to about 150 mg, about 150 mg to about 175 mg, about 175 mg to about 200 mg, about 200 mg to about 225 mg, about 225 mg to about 250 mg, about 250 mg to about 275 mg, about 275 mg to about 300 mg, about 300 mg to about 325 mg, about 325 mg to about 350 mg, about 350 mg to about 375 mg, about 375 mg to about 400 mg, about 400 mg to about 425 mg, about 425 mt to about 450 mg, about 450 mg, to about 475 mg, or about 475 mg to about 500 mg per dose.

In some embodiments, a masked IL-2 polypeptide described herein is administered to a subject at a dosage based on the subject's weight or body surface area (BSA). Depending on the type and severity of the disease, about 1 µg/kg to 15 mg/kg (e.g. 0.1 mg/kg-10 mg/kg) of masked IL-2 polypeptide can be an initial candidate dosage for administration to the patient, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. One exemplary dosage of the masked IL-2 polypeptide would be in the range from about 0.05 mg/kg to about 10 mg/kg. Thus, one or more doses of about 0.5 mg/kg, 2.0 mg/kg, 4.0 mg/kg or 10 mg/kg (or any combination thereof) may be administered to the patient. In some embodiments, a masked IL-2 polypeptide described herein is administered to a subject at a dosage from about 0.1 mg/kg to about 10 mg/kg or about 1.0 mg/kg to about 10 mg/kg. In some embodiments, a masked IL-2 polypeptide described herein is administered to a subject at a dosage of about any of 0.1 mg/kg, 0.5 mg/kg, 1.0 mg/kg, 1.5 mg/kg, 2.0 mg/kg, 2.5 mg/kg, 3.0 mg/kg, 3.5 mg/kg, 4.0 mg/kg, 4.5 mg/kg, 5.0 mg/kg, 5.5 mg/kg, 6.0 mg/kg, 6.5 mg/kg, 7.0 mg/kg, 7.5 mg/kg, 8.0 mg/kg, 8.5 mg/kg, 9.0 mg/kg, 9.5 mg/kg, or 10.0 mg/kg. In some embodiments, a masked IL-2 polypeptide described herein is administered to a subject at a dosage of about or at least about 0.1 mg/kg, about or at least about 0.5 mg/kg, about or at least about 1.0 mg/kg, about or at least about 1.5 mg/kg, about or at least about 2.0 mg/kg, about or at least about 2.5 mg/kg, about or at least about 3.0 mg/kg, about or at least about 3.5 mg/kg, about or at least about 4.0 mg/kg, about or at least about 4.5 mg/kg, about or at least about 5.0 mg/kg, about or at least about 5.5 mg/kg, about or at least about 6.0 mg/kg, about or at least about 6.5 mg/kg, about or at least about 7.0 mg/kg, about or at least about 7.5 mg/kg, about or at least about 8.0 mg/kg, about or at least about 8.5 mg/kg, about or at least about 9.0 mg/kg, about or at least about 9.5 mg/kg, about or at least about 10.0 mg/kg, about or at least about 15.0 mg/kg, about or at least about 20 mg/kg, about or at least about 30 mg/kg, about or at least about 40 mg/kg, about or at least about 50 mg/kg, about or at least about 60 mg/kg, about or at least about 70 mg/kg, about or at least about 80 mg/kg, about or at least about 90 mg/kg, or about or at least about 100 mg/kg. Any of the dosing frequencies described above may be used.

In some embodiments, a masked IL-15 polypeptide described herein is administered at a flat dose. In some embodiments, a masked IL-15 polypeptide described herein is administered to a subject at a dosage from about 25 mg to about 500 mg per dose. In some embodiments, the masked IL-15 polypeptide is administered to a subject at a dosage of about 25 mg to about 50 mg, about 50 mg to about 75 mg, about 75 mg to about 100 mg, about 100 mg to about 125 mg, about 125 mg to about 150 mg, about 150 mg to about 175 mg, about 175 mg to about 200 mg, about 200 mg to about 225 mg, about 225 mg to about 250 mg, about 250 mg to about 275 mg, about 275 mg to about 300 mg, about 300 mg to about 325 mg, about 325 mg to about 350 mg, about 350 mg to about 375 mg, about 375 mg to about 400 mg, about 400 mg to about 425 mg, about 425 mg to about 450 mg, about 450 mg, to about 475 mg, or about 475 mg to about 500 mg per dose.

In some embodiments, a masked IL-15 polypeptide described herein is administered to a subject at a dosage based on the subject's weight or body surface area (BSA). Depending on the type and severity of the disease, about 1 µg/kg to 15 mg/kg (e.g. 0.1 mg/kg-10 mg/kg) of masked IL-15 polypeptide can be an initial candidate dosage for administration to the patient, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. Thus, one or more doses of about 0.5 mg/kg, 2.0 mg/kg, 4.0 mg/kg or 10 mg/kg (or any combination thereof) may be administered to the patient. In some embodiments, a masked IL-15 polypeptide described herein is administered to a subject at a dosage from about 25 mg to about 500 mg per dose. In some embodiments, a masked IL-15 polypeptide described herein is administered to a subject at a dosage from about 0.1 mg/kg to about 10 mg/kg or about 1.0 mg/kg to about 10 mg/kg. In some embodiments, a masked IL-15 polypeptide described herein is administered to a subject at a dosage of about any of 0.1 mg/kg, 0.5 mg/kg, 1.0 mg/kg, 1.5 mg/kg, 2.0 mg/kg, 2.5 mg/kg, 3.0 mg/kg, 3.5 mg/kg, 4.0 mg/kg, 4.5 mg/kg, 5.0 mg/kg, 5.5 mg/kg, 6.0 mg/kg, 6.5 mg/kg, 7.0 mg/kg, 7.5 mg/kg, 8.0 mg/kg, 8.5 mg/kg, 9.0 mg/kg, 9.5 mg/kg, or 10.0 mg/kg. In some embodiments, a masked IL-15 polypeptide described herein is administered to a subject at a dosage of about or at least about 0.1 mg/kg, about or at least about 0.5 mg/kg, about or at least about 1.0 mg/kg, about or at least about 1.5 mg/kg, about or at least about 2.0 mg/kg, about or at least about 2.5 mg/kg, about or at least about 3.0 mg/kg, about or at least about 3.5 mg/kg, about or at least about 4.0 mg/kg, about or at least about 4.5 mg/kg, about or at least about 5.0 mg/kg, about or at least about 5.5 mg/kg, about or at least about 6.0 mg/kg, about or at least about 6.5 mg/kg, about or at least about 7.0 mg/kg, about or at least about 7.5 mg/kg, about or at least about 8.0 mg/kg, about or at least about 8.5 mg/kg, about or at least about 9.0 mg/kg, about or at least about 9.5 mg/kg, about or at least about 10.0 mg/kg, about or at least about 15.0 mg/kg, about or at least about 20 mg/kg, about or at least about 30 mg/kg, about or at least about 40 mg/kg, about or at least about 50 mg/kg, about or at least about 60 mg/kg, about or at least about 70 mg/kg, about or at least about 80 mg/kg, about or at least about 90 mg/kg, or about or at least about 100 mg/kg. Any of the dosing frequencies described above may be used.

A method of treatment contemplated herein is the treatment of a disorder or disease with any of the masked cytokines or compositions described herein. In some embodiments, the method of treatment uses any masked IL-2 polypeptide described herein, or any masked IL-15 polypeptide described herein, or any of the compositions comprising a masked cytokine described herein. Disorders or diseases that are treatable with the formulations of this present invention include leukemia, lymphoma, head and neck cancer, colorectal cancer, prostate cancer, pancreatic cancer, melanoma, breast cancer, neuroblastoma, lung cancer, ovarian cancer, osteosarcoma, bladder cancer, cervical cancer, liver cancer, kidney cancer, skin cancer (e.g., Merkel cell carcinoma) or testicular cancer.

In some embodiments, provided herein is a method of treatment or prevention of a cancer by administration of any masked cytokines or compositions described herein. In some embodiments, provided herein is a method of treatment or prevention of a cancer by administration of a masked IL-2 polypeptide, or a masked IL-15 polypeptide, or any of the compositions comprising a masked cytokine described herein. As used herein, the term "cancer" refers to all types of cancer, neoplasm or malignant tumors found in mammals, including leukemias, lymphomas, melanomas, neuroendocrine tumors, carcinomas and sarcomas. Exemplary cancers that may be treated with a masked cytokine, pharmaceutical composition, or method provided herein, include lymphoma, sarcoma, bladder cancer, bone cancer, brain tumor, cervical cancer, colon cancer, esophageal cancer, gastric cancer, head and neck cancer, kidney cancer, myeloma, thyroid cancer, leukemia, prostate cancer, breast cancer (e.g. triple negative, ER positive, ER negative, chemotherapy resistant, Herceptin resistant, HER2 positive, doxorubicin resistant, tamoxifen resistant, ductal carcinoma, lobular carcinoma, primary, metastatic), ovarian cancer, pancreatic cancer, liver cancer (e.g. hepatocellular carcinoma), lung cancer (e.g. non-small cell lung carcinoma, squamous cell lung carcinoma, adenocarcinoma, large cell lung carcinoma, small cell lung carcinoma, carcinoid, sarcoma), glioblastoma multiforme, glioma, melanoma, prostate cancer, castration-resistant prostate cancer, breast cancer, triple negative breast cancer, glioblastoma, ovarian cancer, lung cancer, squamous cell carcinoma (e.g., head, neck, or esophagus), colorectal cancer, leukemia, acute myeloid leukemia, lymphoma, B cell lymphoma, or multiple myeloma. Additional examples include, cancer of the thyroid, endocrine system, brain, breast, cervix, colon, head & neck, esophagus, liver, kidney, lung, non-small cell lung, melanoma, mesothelioma, ovary, sarcoma, stomach, uterus or Medulloblastoma, Hodgkin's Disease, Non-Hodgkin's Lymphoma, multiple myeloma, neuroblastoma, glioma, glioblastoma multiforme, ovarian cancer, rhabdomyosarcoma, primary thrombocytosis, primary macroglobulinemia, primary brain tumors, cancer, malignant pancreatic insulanoma, malignant carcinoid, urinary bladder cancer, premalignant skin lesions, testicular cancer, lymphomas, thyroid cancer, neuroblastoma, esophageal cancer, genitourinary tract cancer, malignant hypercalcemia, endometrial cancer, adrenal cortical cancer, neoplasms of the endocrine or exocrine pancreas, medullary thyroid cancer, medullary thyroid carcinoma, melanoma, colorectal cancer, papillary thyroid cancer, hepatocellular carcinoma, Paget's Disease of the Nipple, Phyllodes Tumors, Lobular Carcinoma, Ductal Carcinoma, cancer of the pancreatic stellate cells, cancer of the hepatic stellate cells, or prostate cancer.

In some embodiments, provided herein is a method of treatment or prevention of a leukemia by administration of any masked cytokine or composition described herein. The term "leukemia" refers broadly to progressive, malignant diseases of the blood-forming organs and is generally characterized by a distorted proliferation and development of leukocytes and their precursors in the blood and bone marrow. Leukemia is generally clinically classified on the basis of (1) the duration and character of the disease-acute or chronic; (2) the type of cell involved; myeloid (myelogenous), lymphoid (lymphogenous), or monocytic; and (3) the increase or non-increase in the number abnormal cells in the blood-leukemic or aleukemic (subleukemic). Exemplary leukemias that may be treated with a compound, pharmaceutical composition, or method provided herein include, for example, acute nonlymphocytic leukemia, chronic lymphocytic leukemia, acute granulocytic leukemia, chronic granulocytic leukemia, acute promyelocytic leukemia, adult T-cell leukemia, aleukemic leukemia, a leukocythemic leukemia, basophylic leukemia, blast cell leukemia, bovine leukemia, chronic myelocytic leukemia, leukemia cutis, embryonal leukemia, eosinophilic leukemia, Gross' leukemia, hairy-cell leukemia, hemoblastic leukemia, hemocytoblastic leukemia, histiocytic leukemia, stem cell leukemia, acute monocytic leukemia, leukopenic leukemia, lymphatic leukemia, lymphoblastic leukemia, lymphocytic leukemia, lymphogenous leukemia, lymphoid leukemia, lymphosarcoma cell leukemia, mast cell leukemia, megakaryocytic leukemia, micromyeloblastic leukemia, monocytic leukemia, myeloblastic leukemia, myelocytic leukemia, myeloid granulocytic leukemia, myelomonocytic leukemia, Naegeli leukemia, plasma cell leukemia, multiple myeloma, plasmacytic leukemia, promyelocytic leukemia, Rieder cell leukemia, Schilling's leukemia, stem cell leukemia, subleukemic leukemia, or undifferentiated cell leukemia.

In some embodiments, provided herein is a method of treatment or prevention of a sarcoma by administration of any masked cytokine or composition described herein. The term "sarcoma" generally refers to a tumor which is made up of a substance like the embryonic connective tissue and is generally composed of closely packed cells embedded in a fibrillar or homogeneous substance. Sarcomas that may be treated with a compound, pharmaceutical composition, or method provided herein include a chondrosarcoma, fibrosarcoma, lymphosarcoma, melanosarcoma, myxosarcoma, osteosarcoma, Abernethy's sarcoma, adipose sarcoma, liposarcoma, alveolar soft part sarcoma, ameloblastic sarcoma, botryoid sarcoma, chloroma sarcoma, chorio carcinoma, embryonal sarcoma, Wilms' tumor sarcoma, endometrial sarcoma, stromal sarcoma, Ewing's sarcoma, fascial sarcoma, fibroblastic sarcoma, giant cell sarcoma, granulocytic sarcoma, Hodgkin's sarcoma, idiopathic multiple pigmented hemorrhagic sarcoma, immunoblastic sarcoma of B cells, lymphoma, immunoblastic sarcoma of T-cells, Jensen's sarcoma, Kaposi's sarcoma, Kupffer cell sarcoma, angiosarcoma, leukosarcoma, malignant mesenchymoma sarcoma, parosteal sarcoma, reticulocytic sarcoma, Rous sarcoma, serocystic sarcoma, synovial sarcoma, or telangiectaltic sarcoma.

In some embodiments, provided herein is a method of treatment or prevention of a melanoma by administration of any masked cytokine or composition described herein. The term "melanoma" is taken to mean a tumor arising from the melanocytic system of the skin and other organs. Melanomas that may be treated with a compound, pharmaceutical composition, or method provided herein include, for example, acral-lentiginous melanoma, amelanotic melanoma, benign juvenile melanoma, Cloudman's melanoma, S91 melanoma, Harding-Passey melanoma, juvenile melanoma, lentigo maligna melanoma, malignant melanoma, nodular melanoma, subungal melanoma, or superficial spreading melanoma.

In some embodiments, provided herein is a method of treatment or prevention of a carcinoma by administration of any masked cytokine or composition described herein. The term "carcinoma" refers to a malignant new growth made up of epithelial cells tending to infiltrate the surrounding tissues and give rise to metastases. Exemplary carcinomas that may be treated with a compound, pharmaceutical composition, or method provided herein include, for example, medullary thyroid carcinoma, familial medullary thyroid carcinoma, acinar carcinoma, acinous carcinoma, adenocystic carcinoma, adenoid cystic carcinoma, carcinoma adenomatosum, carcinoma of adrenal cortex, alveolar carcinoma, alveolar cell carcinoma, basal cell carcinoma, carcinoma basocellulare, basaloid carcinoma, basosquamous cell carcinoma, bronchioalveolar carcinoma, bronchiolar carcinoma, bronchogenic carcinoma, cerebriform carcinoma, cholangiocellular carcinoma, chorionic carcinoma, colloid carcinoma, comedo carcinoma, corpus carcinoma, cribriform carcinoma, carcinoma en cuirasse, carcinoma cutaneum, cylindrical carcinoma, cylindrical cell carcinoma, duct carcinoma, ductal carcinoma, carcinoma durum, embryonal carcinoma, encephaloid carcinoma, epiermoid carcinoma, carcinoma epitheliale adenoides, exophytic carcinoma, carcinoma ex ulcere, carcinoma fibrosum, gelatiniforni carcinoma, gelatinous carcinoma, giant cell carcinoma, carcinoma gigantocellulare, glandular carcinoma, granulosa cell carcinoma, hair-matrix carcinoma, hematoid carcinoma, hepatocellular carcinoma, Hurthle cell carcinoma, hyaline carcinoma, hypernephroid carcinoma, infantile embryonal carcinoma, carcinoma in situ, intraepidermal carcinoma, intraepithelial carcinoma, Krompecher's carcinoma, Kulchitzky-cell carcinoma, large-cell carcinoma, lenticular carcinoma, carcinoma lenticulare, lipomatous carcinoma, lobular carcinoma, lymphoepithelial carcinoma, carcinoma medullare, medullary carcinoma, melanotic carcinoma, carcinoma molle, mucinous carcinoma, carcinoma muciparum, carcinoma mucocellulare, mucoepidermoid carcinoma, carcinoma mucosum, mucous carcinoma, carcinoma myxomatodes, nasopharyngeal carcinoma, oat cell carcinoma, carcinoma ossificans, osteoid carcinoma, papillary carcinoma, periportal carcinoma, preinvasive carcinoma, prickle cell carcinoma, pultaceous carcinoma, renal cell carcinoma of kidney, reserve cell carcinoma, carcinoma sarcomatodes, schneiderian carcinoma, scirrhous carcinoma, carcinoma scroti, signet-ring cell carcinoma, carcinoma simplex, small-cell carcinoma, solanoid carcinoma, spheroidal cell carcinoma, spindle cell carcinoma, carcinoma spongiosum, squamous carcinoma, squamous cell carcinoma, string carcinoma, carcinoma telangiectaticum, carcinoma telangiectodes, transitional cell carcinoma, carcinoma tuberosum, tubular carcinoma, tuberous carcinoma, verrucous carcinoma, or carcinoma villosum.

In some embodiments, provided herein is a method of treatment or prevention of metastatic cancer by administration of any masked cytokine or composition described herein. As used herein, the terms "metastasis," "metastatic," and "metastatic cancer" can be used interchangeably and refer to the spread of a neoplastic disease or disorder, e.g., cancer, from one organ or another non-adjacent organ or body part. Cancer occurs at an originating site, e.g., breast, which site is referred to as a primary tumor, e.g., primary breast cancer. Some cancer cells in the primary tumor or originating site acquire the ability to penetrate and infiltrate surrounding normal tissue in the local area and/or the ability to penetrate the walls of the lymphatic system or vascular system circulating through the system to other sites and tissues in the body. A second clinically detectable tumor formed from cancer cells of a primary tumor is referred to as a metastatic or secondary tumor. When cancer cells metastasize, the metastatic tumor and its cells are presumed to be similar to those of the original tumor. Thus, if lung cancer metastasizes to the breast, the secondary tumor at the site of the breast consists of abnormal lung cells and not abnormal breast cells. The secondary tumor in the breast is referred to a metastatic lung cancer. Thus, the phrase metastatic cancer refers to a disease in which a subject has or had a primary tumor and has one or more secondary tumors. The phrases non-metastatic cancer or subjects with cancer that is not metastatic refers to diseases in which subjects have a primary tumor but not one or more secondary tumors. For example, metastatic lung cancer refers to a disease in a subject with or with a history of a primary lung tumor and with one or more secondary tumors at a second location or multiple locations, e.g., in the breast.

In some embodiments, provided herein is a method of treatment or prevention of a cancer by administration of any masked cytokine or composition described herein in combination with an anti-cancer agent. The anti-cancer agent can be any agent capable of reducing cancer growth, interfering with cancer cell replication, directly or indirectly killing cancer cells, reducing metastasis, reducing tumor blood supply, or reducing cell survival. In some embodiments, the anti-cancer agent is selected from the group consisting of a PD-1 inhibitor, an EGFR inhibitor, a HER2 inhibitor, a VEGFR inhibitor, a CTLA-4 inhibitor, a BTLA inhibitor, a B7H4 inhibitor, a B7H3 inhibitor, a CSFIR inhibitor, an HVEM inhibitor, a CD27 inhibitor, a KIR inhibitor, an NKG2A inhibitor, an NKG2D agonist, a TWEAK inhibitor, an ALK inhibitor, a CD52 targeting antibody, a CCR4 targeting antibody, a PD-L1 inhibitor, a KIT inhibitor, a PDGFR inhibitor, a BAFF inhibitor, an HDAC inhibitor, a VEGF ligand inhibitor, a CD19 targeting molecule, a FOLR1 targeting molecule, a DLL3 targeting molecule, a DKK1 targeting molecule, a MUC1 targeting molecule, a MUC16 targeting molecule, a PSMA targeting molecule, an MSLN targeting molecule, an NY-ES0-1 targeting molecule, a B7H3 targeting molecule, a B7H4 targeting molecule, a BCMA targeting molecule, a CD29 targeting molecule, a CD151targeting molecule, a CD123 targeting molecule, a CD33 targeting molecule, a CD37 targeting molecule, a CDH19 targeting molecule, a CEA targeting molecule, a Claudin 18.2 targeting molecule, a CLEC12A targeting molecule, an EGFRVIII targeting molecule, an EPCAM targeting molecule, an EPHA2 targeting molecule, an FCRH5 targeting molecule, an FLT3 targeting molecule, a GD2 targeting molecule, a glypican 3 targeting molecule, a gpA33 targeting molecule, a GPRC5D targeting molecule, an IL-23R targeting molecule, an IL-1RAP targeting molecule, a MCSP targeting molecule, a RON targeting molecule, a ROR1 targeting molecule, a STEAP2 targeting molecule, a TfR targeting molecule, a CD166 targeting molecule, a TPBG targeting molecule, a TROP2 targeting molecule, a proteasome inhibitor, an ABL inhibitor, a CD30 inhibitor, a FLT3 inhibitor, a MET inhibitor, a RET inhibitor, an IL-1β inhibitor, a MEK inhibitor, a ROS1 inhibitor, a BRAF inhibitor, a CD38 inhibitor, a RANKL inhibitor, a B4GALNT1 inhibitor, a SLAMF7 inhibitor, an IDH2 inhibitor, an mTOR inhibitor, a CD20 targeting antibody, a BTK inhibitor, a PI3K inhibitor, a FLT3 inhibitor, a PARP inhibitor, a CDK4 inhibitor, a CDK6 inhibitor, an FGFR inhibitor, a RAF inhibitor, a JAK1 inhibitor, a JAK2 inhibitor, a JAK3 inhibitor, an IL-6 inhibitor, a IL-17 inhibitor, a Smoothened inhibitor, an IL-6R inhibitor, a BCL2 inhibitor, a PTCH inhibitor, a PIGF inhibitor, a TGFB inhibitor, a CD28 agonist, a CD3 agonist, CD40 agonist, a GITR agonist, a OX40 agonist, a VISTA agonist, a CD137 agonist, a LAG3 inhibitor, a TIM3 inhibitor, a TIGIT inhibitor, and an IL-2R inhibitor.

In some embodiments, provided herein is a method of treatment or prevention of a cancer by administration of any masked cytokine described herein in combination with an anti-inflammatory agent. The anti-inflammatory agent can be any agent capable of preventing, counteracting, inhibiting, or otherwise reducing inflammation.

In some embodiments, the anti-inflammatory agent is a cyclooxygenase (COX) inhibitor. The COX inhibitor can be any agent that inhibits the activity of COX-1 and/or COX-2. In some embodiments, the COX inhibitor selectively inhibits COX-1 (i.e., the COX inhibitor inhibits the activity of COX-1 more than it inhibits the activity of COX-2). In some embodiments, the COX inhibitor selectively inhibits COX-2 (i.e., the COX inhibitor inhibits the activity of COX-2 more than it inhibits the activity of COX-1). In some embodiments, the COX inhibitor inhibits both COX-1 and COX-2.

In some embodiments, the COX inhibitor is a selective COX-1 inhibitor and is selected from the group consisting of SC-560, FR122047, P6, mofezolac, TFAP, flurbiprofen, and ketoprofen. In some embodiments, the COX inhibitor is a selective COX-2 inhibitor and is selected from the group consisting of celecoxib, rofecoxib, meloxicam, piroxicam, deracoxib, parecoxib, valdecoxib, etoricoxib, a chromene derivative, a chroman derivative, N-(2-cyclohexyloxynitrophenyl) methane sulfonamide, parecoxib, lumiracoxib, RS 57067, T-614, BMS-347070, JTE-522, S-2474, SVT-2016, CT-3, ABT-963, SC-58125, nimesulide, flosulide, NS-398, L-745337, RWJ-63556, L-784512, darbufelone, CS-502, LAS-34475, LAS-34555, S-33516, diclofenac, mefenamic acid, and SD-8381. In some embodiments, the COX inhibitor is selected from the group consisting of ibuprofen, naproxen, ketorolac, indomethacin, aspirin, naproxen, tolmetin, piroxicam, and meclofenamate. In some embodiments, the COX inhibitor is selected from the group consisting of SC-560, FR122047, P6, mofezolac, TFAP, flurbiprofen, ketoprofen, celecoxib, rofecoxib, meloxicam, piroxicam, deracoxib, parecoxib, valdecoxib, etoricoxib, a chromene derivative, a chroman derivative, N-(2-cyclohexyloxynitrophenyl) methane sulfonamide, parecoxib, lumiracoxib, RS 57067, T-614, BMS-347070, JTE-522, S-2474, SVT-2016, CT-3, ABT-963, SC-58125, nimesulide, flosulide, NS-398, L-745337, RWJ-63556, L-784512, darbufelone, CS-502, LAS-34475, LAS-34555, S-33516, diclofenac, mefenamic acid, SD-8381, ibuprofen, naproxen, ketorolac, indomethacin, aspirin, naproxen, tolmetin, piroxicam, and meclofenamate.

In some embodiments, the anti-inflammatory agent is an NF-KB inhibitor. The NF-κB inhibitor can be any agent that inhibits the activity of the NF-κB pathway. In some embodiments, the NF-κB inhibitor is selected from the group consisting of an IKK complex inhibitor, an IκB degradation inhibitor, an NF-κB nuclear translocation inhibitor, a p65 acetylation inhibitor, an NF-κB DNA binding inhibitor, an NF-κB transactivation inhibitor, and a p53 induction inhibitor.

In some embodiments, the IKK complex inhibitor is selected from the group consisting of TPCA-1, NF-κB Activation Inhibitor VI (BOT-64), BMS-345541, amlexanox, SC-514 (GK-01140), IMD-0354, and IKK-16. In some embodiments, the IKB degradation inhibitor is selected from the group consisting of BAY-11-7082, MG-115, MG-132, lactacystin, epoxomicin, parthenolide, carfilzomib, and MLN-4924 (pevonedistat). In some embodiments, the NF-κB nuclear translocation inhibitor is selected from the group consisting of JSH-23 and rolipram. In some embodiments, the p65 acetylation inhibitor is selected from the group consisting of gallic acid and anacardic acid. In some embodiments, the NF-κB DNA binding inhibitor is selected from the group consisting of GYY-4137, p-XSC, CV-3988, and prostaglandin E2 (PGE2). In some embodiments, the NF-κB transactivation inhibitor is selected from the group consisting of LY-294002, wortmannin, and mesalamine In some embodiments, the p53 induction inhibitor is selected from the group consisting of quinacrine and flavopiridol. In some embodiments, the NF-κB inhibitor is selected from the group consisting of TPCA-1, NF-κB Activation Inhibitor VI (BOT-64), BMS-345541, amlexanox, SC-514 (GK-01140), IMD-0354, IKK-16, BAY-11-7082, MG-115, MG-132, lactacystin, epoxomicin, parthenolide, carfilzomib, MLN-4924 (pevonedistat), JSH-23 rolipram, gallic acid, anacardic acid, GYY-4137, p-XSC, CV-3988, prostaglandin E2 (PGE2), LY-294002, wortmannin, mesalamine, quinacrine, and flavopiridol.

In some embodiments, provided herein is a method of treatment or prevention of a cancer by administration of any masked cytokine or composition described herein in combination with an anti-cancer therapeutic protein. The anti-cancer therapeutic protein can be any therapeutic protein capable of reducing cancer growth, interfering with cancer cell replication, directly or indirectly killing cancer cells, reducing metastasis, reducing tumor blood supply, or reducing cell survival. Exemplary anti-cancer therapeutic proteins may come in the form of an antibody or fragment thereof, an antibody derivative, a bispecific antibody, a chimeric antigen receptor (CAR) T cell, a fusion protein, or a bispecific T-cell engager (BiTE).

In some embodiments, provided herein is a method of treatment or prevention of an inflammatory or autoimmune disease by administration of any masked cytokine or composition described herein. The term "inflammatory disease" refers to a disease caused by, resulting from, or resulting in, inflammation. The term "autoimmune disease" refers to a disease in which the subject's own immune system attacks its own cells or tissues.

In some embodiments, the inflammatory or autoimmune disease is selected from the group consisting of atherosclerosis, obesity, inflammatory bowel disease (IBD), rheumatoid arthritis, allergic encephalitis, psoriasis, atopic skin disease, osteoporosis, peritonitis, hepatitis, lupus, celiac disease, Sjogren's syndrome, polymyalgia rheumatica, multiple sclerosis (MS), ankylosing spondylitis, type 1 diabetes mellitus, alopecia areata, vasculitis, and temporal arteritis, graft versus host disease (GVHD), asthma, COPD, a paraneoplastic autoimmune disease, cartilage inflammation, juvenile arthritis, juvenile rheumatoid arthritis, pauciarticular juvenile rheumatoid arthritis, polyarticular juvenile rheumatoid arthritis, systemic onset juvenile rheumatoid arthritis, juvenile ankylosing spondylitis, juvenile enteropathic arthritis, juvenile reactive arthritis, juvenile Reiter's Syndrome, SEA Syndrome (Seronegativity, Enthesopathy, Arthropathy Syndrome), juvenile dermatomyositis, juvenile psoriatic arthritis, juvenile Scleroderma, juvenile systemic lupus erythematosus, juvenile vasculitis, pauciarticular rheumatoid arthritis, systemic onset rheumatoid arthritis, enteropathic arthritis, reactive arthritis, Reiter's Syndrome, dermatomyositis, psoriatic arthritis, Scleroderma, vasculitis, myolitis, polymyolitis, dermatomyolitis, polyarteritis nodossa, Wegener's granulomatosis, arteritis, ploymyalgia rheumatica, sarcoidosis, Sclerosis, primary biliary Sclerosis, Sclerosing cholangitis, psoriasis, plaque psoriasis, guttate psoriasis, inverse psoriasis, pustular psoriasis, erythrodermic psoriasis, dermatitis, atopic dermatitis, atherosclerosis, Still's disease, Systemic Lupus Erythematosus (SLE), myasthenia gravis, Crohn's disease, ulcerative colitis, celiac disease, rhinosinusitis, rhinosinusitis with polyps, eosinophilic esophogitis, eosinophilic bronchitis, Guillain-Barre disease, thyroiditis (e.g., Graves' disease), Addison's disease, Raynaud's phenomenon, autoimmune hepatitis, transplantation rejection, kidney damage, hepatitis C-induced vasculitis, and spontaneous loss of pregnancy.

V. ARTICLES OF MANUFACTURE OR KITS

In another aspect, an article of manufacture or kit is provided which comprises any masked cytokine described herein. The article of manufacture or kit may further comprise instructions for use of the cytokines in the methods of the invention. Thus, in certain embodiments, the article of manufacture or kit comprises instructions for the use of a masked cytokine in methods for treating or preventing a disorder (e.g., a cancer) in an individual comprising administering to the individual an effective amount of a masked cytokine. For example, in certain embodiments, the article of manufacture or kit comprises instructions for the use of a masked IL-2 polypeptide in methods for treating or preventing a disorder (e.g., a cancer) in an individual comprising administering to the individual an effective amount of a masked IL-2 polypeptide. In certain embodiments, the individual is a human In some embodiments, the individual has a disease selected from the group consisting of include leukemia, lymphoma, head and neck cancer, colorectal cancer, prostate cancer, pancreatic cancer, melanoma, breast cancer, neuroblastoma, lung cancer, ovarian cancer, osteosarcoma, bladder cancer, cervical cancer, liver cancer, kidney cancer, skin cancer or testicular cancer.

The article of manufacture or kit may further comprise a container. Suitable containers include, for example, bottles, vials (e.g., dual chamber vials), syringes (such as single or dual chamber syringes), test tubes, and intravenous (IV) bags. The container may be formed from a variety of materials such as glass or plastic. The container holds the formulation. In some embodiments, the formulation is a lyophilized formulation. In some embodiments, the formulation is a frozen formulation. In some embodiments, the formulation is a liquid formulation.

The article of manufacture or kit may further comprise a label or a package insert, which is on or associated with the container, may indicate directions for reconstitution and/or use of the formulation. The label or package insert may further indicate that the formulation is useful or intended for subcutaneous, intravenous, or other modes of administration for treating or preventing a disorder (e.g., a cancer) in an individual. The container holding the formulation may be a single-use vial or a multi-use vial, which allows for repeat administrations of the reconstituted formulation. The article of manufacture or kit may further comprise a second container comprising a suitable diluent. The article of manufacture or kit may further include other materials desirable from a commercial, therapeutic, and user standpoint, including other buffers, diluents, filters, needles, syringes, and package inserts with instructions for use.

In a specific embodiment, the present invention provides kits for a single dose-administration unit. Such kits comprise a container of an aqueous formulation of therapeutic cytokine, including both single or multi-chambered pre-filled syringes. Exemplary pre-filled syringes are available from Vetter GmbH, Ravensburg, Germany.

The article of manufacture or kit herein optionally further comprises a container comprising a second medicament, wherein the masked cytokine is a first medicament, and which article or kit further comprises instructions on the label or package insert for treating the subject with the second medicament, in an effective amount.

In another embodiment, provided herein is an article of manufacture or kit comprising the formulations described herein for administration in an auto-injector device. An auto-injector can be described as an injection device that upon activation, will deliver its contents without additional necessary action from the patient or administrator. They are particularly suited for self-medication of therapeutic formulations when the delivery rate must be constant and the time of delivery is greater than a few moments.

VI. DEFINITIONS

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

It is to be understood that this invention is not limited to particular compositions or biological systems, which can, of course, vary. It is also to be understood that the terminology used herein is for the purpose of describing particular embodiments only, and is not intended to be limiting. As used in this specification and the appended claims, the singular forms "a," "an," and "the" include plural referents unless the content clearly dictates otherwise. Thus, for example, reference to "an IL-2 polypeptide" optionally includes a combination of two or more such polypeptides, and the like.

The term "about" as used herein refers to the usual error range for the respective value readily known to the skilled person in this technical field. Reference to "about" a value or parameter herein includes (and describes) embodiments that are directed to that value or parameter per se.

It is understood that aspects and embodiments of the invention described herein include "comprising," "consisting," and "consisting essentially of" aspects and embodiments.

As used herein, the term "and/or" refers to any one of the items, any combination of the items, or all of the items with which the term is associated. For instance, the phrase "A, B, and/or C" is intended to encompass each of the following embodiments: A, B, and C; A, B, or C; A or B; A or C; B or C; A and B; A and C; B and C; A and B or C; B and A or C; C and A or B; A (alone); B (alone); and C (alone).

The term "antibody" includes polyclonal antibodies, monoclonal antibodies (including full length antibodies which have an immunoglobulin Fc region), antibody compositions with polyepitopic specificity, multispecific antibodies (e.g., bispecific antibodies, diabodies, and single-chain molecules, as well as antibody fragments (e.g., Fab, F(ab')2, and Fv). The term "immunoglobulin" (Ig) is used interchangeably with "antibody" herein.

The term "diabodies" refers to small antibody fragments with two antigen-binding sites, which comprise a heavy chain variable (VH) domain connected to a light chain variable (VL) domain in the same polypeptide chain (VH-VL).

The basic 4-chain antibody unit is a heterotetrameric glycoprotein composed of two identical light (L) chains and two identical heavy (H) chains An IgM antibody consists of 5 of the basic heterotetramer units along with an additional polypeptide called a J chain, and contains 10 antigen binding sites, while IgA antibodies comprise from 2-5 of the basic 4-chain units which can polymerize to form polyvalent assemblages in combination with the J chain In the case of IgGs, the 4-chain unit is generally about 150,000 daltons. Each L chain is linked to an H chain by one covalent disulfide bond, while the two H chains are linked to each other by one or more disulfide bonds depending on the H chain isotype. Each H and L chain also has regularly spaced intrachain disulfide bridges. Each H chain has at the N-terminus, a variable domain (VH) followed by three constant domains (CH) for each of the α and γ chains and four CH domains for µ and ε isotypes. Each L chain has at the N-terminus, a variable domain (VL) followed by a constant domain at its other end. The VL is aligned with the VH and the CL is aligned with the first constant domain of the heavy chain (CH1). Particular amino acid residues are believed to form an interface between the light chain and heavy chain variable domains. The pairing of a VH and VL together forms a single antigen-binding site. For the structure and properties of the different classes of antibodies, see e.g., Basic and Clinical Immunology, 8th Edition, Daniel P. Sties, Abba I. Ten and Tristram G. Parsolw (eds), Appleton & Lange, Norwalk, Conn., 1994, page 71 and Chapter 6.

The L chain from any vertebrate species can be assigned to one of two clearly distinct types, called kappa and lambda, based on the amino acid sequences of their constant domains. Depending on the amino acid sequence of the constant domain of their heavy chains (CH), immunoglobulins can be assigned to different classes or isotypes. There are five classes of immunoglobulins: IgA, IgD, IgE, IgG and IgM, having heavy chains designated α, δ, ε, γ and µ, respectively. The γ and α classes are further divided into subclasses on the basis of relatively minor differences in the CH sequence and function, e.g., humans express the following subclasses: IgG1, IgG2, IgG3, IgG4, IgA1 and IgA2. IgG1 antibodies can exist in multiple polymorphic variants termed allotypes (reviewed in Jefferis and Lefranc 2009. mAbs Vol 1 Issue 4 1-7) any of which are suitable for use in the invention. Common allotypic variants in human populations are those designated by the letters a,f,n,z.

An "isolated" antibody is one that has been identified, separated and/or recovered from a component of its production environment (e.g., naturally or recombinantly). In some embodiments, the isolated polypeptide is free of association with all other components from its production environment. Contaminant components of its production environment, such as that resulting from recombinant transfected cells, are materials that would typically interfere with research, diagnostic or therapeutic uses for the antibody, and may include enzymes, hormones, and other proteinaceous or non-proteinaceous solutes. In some embodiments, the polypeptide is purified: (1) to greater than 95% by weight of antibody as determined by, for example, the Lowry method, and in some embodiments, to greater than 99% by weight; (1) to a degree sufficient to obtain at least 15 residues of N-terminal or internal amino acid sequence by use of a spinning cup sequenator, or (3) to homogeneity by SDS-PAGE under non-reducing or reducing conditions using Coomassie blue or silver stain. Isolated antibody includes the antibody in situ within recombinant cells since at least one component of the antibody's natural environment will not be present. Ordinarily, however, an isolated polypeptide or antibody is prepared by at least one purification step.

The term "monoclonal antibody" as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. In some embodiments, monoclonal antibodies have a C-terminal cleavage at the heavy chain and/or light chain For example, 1, 2, 3, 4, or 5 amino acid residues are cleaved at the C-terminus of heavy chain and/or light chain. In some embodiments, the C-terminal cleavage removes a C-terminal lysine from the heavy chain. In some embodiments, monoclonal antibodies have an N-terminal cleavage at the heavy chain and/or light chain For example, 1, 2, 3, 4, or 5 amino acid residues are cleaved at the N-terminus of heavy chain and/or light chain. In some embodiments truncated forms of monoclonal antibodies can be made by recombinant techniques. In some embodiments, monoclonal antibodies are highly specific, being directed against a single antigenic site. In some embodiments, monoclonal antibodies are highly specific, being directed against multiple antigenic sites (such as a bispecific antibody or a multispecific antibody). The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including, for example, the hybridoma method, recombinant DNA methods, phage-display technologies, and technologies for producing human or human-like antibodies in animals that have parts or all of the human immunoglobulin loci or genes encoding human immunoglobulin sequences.

The terms "full-length antibody," "intact antibody" or "whole antibody" are used interchangeably to refer to an antibody in its substantially intact form, as opposed to an antibody fragment. Specifically, whole antibodies include those with heavy and light chains including an Fc region. The constant domains may be native sequence constant domains (e.g., human native sequence constant domains) or amino acid sequence variants thereof. In some cases, the intact antibody may have one or more effector functions.

An "antibody fragment" comprises a portion of an intact antibody, such as the antigen binding region and/or the variable region of the intact antibody, and/or the constant region of the intact antibody. Examples of an antibody fragment include the Fc region of the antibody, a portion of the Fc region, or a portion of the antibody comprising the Fc region. Examples of antigen-binding antibody fragments include domain antibodies (dAbs), Fab, Fab', F(ab')2 and Fv fragments; diabodies; linear antibodies (see U.S. Pat. No. 5,641,870, Example 2; Zapata et al., Protein Eng. 8(10): 1057-1062 [1995]); single-chain antibody molecules, and multispecific antibodies formed from antibody fragments. Single heavy chain antibodies or single light chain antibodies can be engineered, or in the case of the heavy chain, can be isolated from camelids, shark, libraries or mice engineered to produce single heavy chain molecules.

Papain digestion of antibodies produced two identical antigen-binding fragments, called "Fab" fragments, and a residual "Fc" fragment, a designation reflecting the ability to crystallize readily. The Fab fragment consists of an entire L chain along with the variable region domain of the H chain (VH), and the first constant domain of one heavy chain (CH1). Each Fab fragment is monovalent with respect to antigen binding, i.e., it has a single antigen-binding site. Pepsin treatment of an antibody yields a single large F(ab')2 fragment which roughly corresponds to two disulfide linked Fab fragments having different antigen-binding activity and is still capable of cross-linking antigen. Fab' fragments differ from Fab fragments by having a few additional residues at the carboxy terminus of the CH1 domain including one or more cysteines from the antibody hinge region. Fab'-SH is the designation herein for Fab' in which the cysteine residue(s) of the constant domains bear a free thiol group. F(ab')2 antibody fragments originally were produced as pairs of Fab' fragments which have hinge cysteines between them. Other chemical couplings of antibody fragments are also known. The Fc fragment comprises the carboxy-terminal portions of both H chains held together by disulfides. The effector functions of antibodies are determined by sequences and glycan in the Fc region, the region which is also recognized by Fc receptors (FcR) found on certain types of cells.

The term "Fc region" herein is used to define a C-terminal region of an immunoglobulin heavy chain, including native-sequence Fc regions and variant Fc regions. Although the boundaries of the Fc region of an immunoglobulin heavy chain might vary, the human IgG heavy-chain Fc region is usually defined to stretch from an amino acid residue at position Cys226, or from Pro230, to the carboxyl-terminus thereof. Suitable native-sequence Fc regions for use in the antibodies of the invention include human IgG1, IgG2, IgG3 and IgG4.

The term "cytokine" refers to a secreted polypeptide or active fragment or mutant thereof that modulates the activity of cells, particularly cells of the immune system. Examples of cytokines include, for instance, chemokines, interferons, interleukins, lymphokines, and tumor necrosis factors. The term encompasses any cytokine protein, or a functional fragment or variant thereof. The term encompasses any native cytokine from any vertebrate source, including mammals such as primates (e.g., humans) and rodents (e.g., rats and mice), unless otherwise indicated. The term encompasses an unprocessed form of the cytokine as well as any form of the cytokine that results from processing in a cell. The term also encompasses naturally occurring variants of a cytokine. The term also encompasses non-naturally occurring variants of a cytokine, such as truncations, deletions, forms where the cytokine is linked to another molecule, and variants caused by at least one amino acid change to the amino acid sequence (e.g., by substitution, addition, or deletion). In some aspects, the variants or homologs have at least 90%, 95%, 96%, 97%, 98%, 99% or 100% amino acid sequence identity across the whole sequence or a portion of the sequence (e.g., a 50, 100, 125, or 150 or more continuous amino acid portion) compared to a naturally occurring cytokine polypeptide.

The term "IL-2" or "IL-2 polypeptide" as used herein refers to any interleukin-2 (IL-2) protein, or a functional fragment or variant thereof. The term encompasses any native IL-2 from any vertebrate source, including mammals such as primates (e.g., humans) and rodents (e.g., rats and mice), unless otherwise indicated. The term encompasses unprocessed IL-2 (e.g., a full length, precursor form of IL-2 that consists of amino acid residues 1-153) as well as any form of IL-2 that results from processing in the cell (e.g., a mature form of IL-2 that consists of amino acid residues 21-153). As such, the term encompasses a protein encoded by the amino acid sequence of SEQ ID NO: 160, as well as sequence variants thereof. The term also encompasses naturally occurring variants of IL-2. The term also encompasses non-naturally occurring variants of IL-2, such as truncations, deletions, forms where IL-2 is linked to another molecule, and variants caused by at least one amino acid change to the amino acid sequence (e.g., by substitution, addition, or deletion). In some aspects, the variants or homologs have at least 90%, 95%, 96%, 97%, 98%, 99% or 100% amino acid sequence identity across the whole sequence or a portion of the sequence (e.g., a 50, 100, or 133 continuous amino acid portion) compared to a naturally occurring IL-2 polypeptide, such as an IL-2 polypeptide encoded by the amino acid sequence of SEQ ID NO: 159 or 160. As such, the term "IL-2" or "IL-2 polypeptide" includes an IL-2 protein comprising the amino acid sequence of any one of SEQ ID NOs: 1-8, 159, 160, 230, 243-251, 260, 775-792, and 813-822, including variants thereof, such as variants created by one or more amino acid substitutions to the amino acid sequence of any one of SEQ ID NOs: 1-8, 159, 160, 230, 243-251, 260, 775-792, and 813-822.

The term "IL-15" or "IL-15 polypeptide" as used herein refers to any interleukin-15 (IL-15) protein, or a functional fragment or variant thereof. The term encompasses any native IL-15 from any vertebrate source, including mammals such as primates (e.g., humans) and rodents (e.g., rats and mice), unless otherwise indicated. The term encompasses unprocessed IL-15 (e.g., a full length, precursor form of IL-15 that consists of amino acid residues 1-162) as well as any form of IL-15 that results from processing in the cell (e.g., a mature form of IL-15 that consists of amino acid residues 49-162). As such, the term encompasses a protein encoded by the amino acid sequence of SEQ ID NO: 167, as well as sequence variants thereof. The term also encompasses naturally occurring variants of IL-15. The term also encompasses non-naturally occurring variants of IL-15, such as truncations, deletions, forms where IL-15 is linked to another molecule, and variants caused by at least one amino acid change to the amino acid sequence (e.g., by substitution, addition, or deletion). In some aspects, the variants or homologs have at least 90%, 95%, 96%, 97%, 98%, 99% or 100% amino acid sequence identity across the whole sequence or a portion of the sequence (e.g., a 50, 100, or 114 continuous amino acid portion) compared to a naturally occurring IL-15 polypeptide, such as an IL-15 polypeptide encoded by the amino acid sequence of SEQ ID NO: 166 or 167. As such, the term "IL-15" or "IL-15 polypeptide" includes an IL-15 protein comprising the amino acid sequence of SEQ ID NO: 166 or 167, including variants thereof, such as variants created by one or more amino acid substitutions to the amino acid sequence of SEQ ID NO: 166 or 167.

"Functional fragments" of a cytokine comprise a portion of a full length cytokine protein which retains or has modified cytokine receptor binding capability (e.g., within at least 50%, 80%, 90%, 95%, 96%, 97%, 98%, 99% or 100% activity compared to the full length cytokine protein). The full length cytokine protein can be a full length cytokine protein of a wildtype cytokine protein, or it can be a full length cytokine protein of a modified variant of a cytokine protein, such as a full length cytokine that has been modified by one or more amino acid substitutions. Cytokine receptor binding capability can be shown, for example, by the capability of a cytokine to bind to the cytokine's cognate receptor or a component thereof (e.g., one or more chain(s) of a heterotrimeric receptor complex). As used herein, "full length" can refer to the full length of a cytokine in its unprocessed (i.e., precursor) form or it's processed (i.e., mature) form. The term also encompasses a portion of a full length protein which retains or has modified cytokine receptor binding capability (e.g., within at least 50%, 80%, 90%, 95%, 96%, 97%, 98%, 99% or 100% activity compared to the full length cytokine protein) and has been further modified to include one or more modifications to the amino acid sequence, such as one or more amino acid deletions, additions, or substitutions. Thus, a functional fragment of a cytokine not only encompasses a portion of a full length cytokine protein, but it also encompasses a variant of a portion of a full length cytokine protein. For instance, a functional fragment of an IL-2 polypeptide comprises a portion of a full length IL-2 protein which retains or has modified IL-2R binding capability (e.g., within at least 50%, 80%, 90%, 95%, 96%, 97%, 98%, 99% or 100% activity compared to full length wildtype IL-2). IL-2R binding capability can be shown, for example, by the capability to bind to the IL-2Rα chain, the IL-2Rβ chain, and/or the IL-2Rγ chain of the IL-2R, either individually or in combination with one another. A functional fragment of IL-2 includes, for example, an IL-2 protein that comprises amino acid residues 21-153 of the full length IL-2 sequence of SEQ ID NO: 159, as well as variants thereof, such as variants that include one or more substitutions to the amino acid sequence. As such, a functional fragment of IL-2 includes, for example, an IL-2 protein comprising the amino acid sequence of any one of SEQ ID NOs: 1-8, 160, 230, 243-251, 260, 775-792, and 813-822. A functional fragment of IL-15 includes, for example, an IL-15 protein comprising the amino acid sequence of SEQ ID NO: 167.

The term "activatable" as used herein to describe any cytokine or functional fragment thereof means a cytokine or functional fragment thereof has been modified to comprise a masking moiety, and, in some embodiments, other components, that allow for activation of the cytokine or functional fragment thereof in a preferred environment. For example, a cytokine or functional fragment thereof that has been modified to comprise an masking moiety for activation in a preferred environment may be referred to herein as an "activatable cytokine," or "masked cytokine," or "activatable masked cytokine." As such, the term "masked cytokine" includes any cytokine or functional fragment thereof that has been modified to comprise a masking moiety, and, in some embodiments, other components, such as a cleavable peptide, that allow for activation of the cytokine or functional fragment thereof in a preferred environment.

The term "masking moiety" as used herein refers to a peptide capable of binding to, or otherwise exhibiting an affinity for, a cytokine or functional fragment thereof such that the masking moiety blocks, occludes, inhibits (e.g., decreases) or otherwise prevents (e.g., masks) the activity or binding of the cytokine or functional fragment thereof to its cognate receptor or protein. In some embodiments, the masking moiety is a cytokine receptor, or a subunit or functional fragment thereof.

The term "cytokine receptor" as used herein refers to any receptor within the art that binds to one or more cytokine(s) including, but not limited to, receptors of IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28A, IL-28B, IL-29, IL-30, IL-31, IL-32, IL-33, IL-34, IL-35, IL-36, IL-37, granulocyte-macrophage colony-stimulating factor (GM-CSF), macrophage colony-stimulating factor (M-CSF), tumor necrosis factor alpha (TNF-α), transforming growth factor beta (TGF-β), IFN-γ (gamma), CD252, CD154, CD178, CD70, CD153, 4-1BB-L, TRAIL, RANKL, APO3L, CD256, CD257, CD258, TL1, AITRL, EDA1, interferon (IFN)-α (alpha), IFN-β (beta), IFN-γ (gamma), growth hormone (GH), erythropoietin (EPO), prolactin (PRL), leukemia inhibitory factor (LIF), oncostatin (OSM), and thrombopoietin (TPO). Some cytokine receptors function, in whole or in part, as heteromeric complexes of more than one subunit, or as homomeric complexes. The term also encompasses subunits of cytokine receptors that are capable of binding to one or more cytokine(s) either individually or when in complex with one or more other cytokine receptor subunits (e.g., as a heteromeric or homomeric complex). As such, reference to a "cytokine receptor" that is a heteromeric complex of three subunits, for example, includes reference to the heteromeric complex comprising all three subunits, as well as reference to each subunit individually or in various combinations with one another. Non-limiting examples of cytokine receptors include CXCR1, CXCR2, CXCR3, CXCR4, CXCR5, CXCR6, CXCR7, CCR1, CCR2, CCR3, CCR4, CCR5, CCR6, CCR7, CCR8, CCR9, CCR10, CCR11, XCR1, CX3CR1, IL-1RAP, IL-1RAPL1, IL-1RAPL2, IL-1RL1, IL-1RL2, IL-1R1, IL-1R2, IL-2R, IL-2Rα, IL-2Rβ, IL-2Rγ, IL-3Rα, IL-4R, IL-5Rα, IL-6R, IL-6ST, IL-7R, IL-9R, IL-10Rα, IL-10Rβ, IL-11Rα, IL-12Rβ1, IL-12Rβ2, IL-13Rα1, IL-13Rα2, IL-15Rα, IL-17RA, IL-17RB, IL-17RC, IL-17RD, IL-17RE, IL-18RAP, IL-18R1, IL-20Rα, IL-20Rβ, IL-21R, IL-22Rα1, IL-22Rα2, IL-23R, IL-27Rα, IL-28Rα, IL-31RA, IFNAR1, IFNAR2, IFNGR1, IFNGR2, IFNLR1, GMRα (CD116), CD131, GHR, PRLR, EPOR, LIFR (CD118), OSMRβ, TPO-R (CD110), CSF-1R, EDAR, TNFRSF1A, TNFRSF1B, LTBR, TNFRSF4, CD40, FAS, TNFRSF6B, CD27, TNFRSF8, TNFRSF9, TNFRSF10A, TNFRSF10B, TNFRSF10C, TNFRSF10D, TNFRSF11A, TNFRSF11B, TNFRSF12A, TNFRSF13B, TNFRSF13C, TNFRSF14, NGFR, TNFRSF17, TNFRSF18, TNFRSF19, RELT, TNFRSF21, TNFRSF25, and EDA2R.

The term "IL-2R" or "IL-2 receptor" or "IL-2 cytokine receptor" as used herein refers to the high-affinity IL-2 receptor complex that comprises three separate and non-covalently linked chains: the IL-2Rα chain (also referred to as CD25), the IL-2Rβ chain (also referred to as CD122), and the IL-2Rγ chain (also referred to as CD132). IL-2 is capable of binding to the IL-2Rα chain IL-2 is also capable of binding to the IL-2Rα chain in combination with the IL-2Rβ chain IL-2 is also capable of binding to the IL-2Rα chain in combination with the IL-2Rβ and IL-2Rγ chains with highest affinity. In some cases, the term also encompasses the IL-2Rα chain, the IL-2Rβ chain, or the IL-2Rγ chain, or combinations thereof.

The term "IL-15R" or "IL-15 receptor" or "IL-15 cytokine receptor" as used herein refers to the high-affinity IL-15 receptor complex that comprises three separate and non-covalently linked chains: the IL-15Rα chain, the IL-2Rβ chain, and the IL-2Rγ chain. IL-15 is capable of binding to the IL-15Rα chain, to the heterodimer of the IL-2Rβ chain and the IL-2Rγ chain, and to the IL-15Rα chain in combination with the IL-2Rβ chain and the IL-2Rγ chain In some cases, the term also encompasses the IL-15Rα chain, the IL-2Rβ chain, or the IL-2Rγ chain, or combinations thereof.

The term "half-life extension domain" refers to a domain that is linked to a target component (e.g., a cytokine or functional fragment thereof, or a masking moiety) for the purpose of extending the half-life of the target component in serum. The term "half-life extension domain" encompasses, for example, antibodies, antibody fragments, bispecific antibodies, albumin, binding proteins (e.g., albumin-binding proteins and IgG-binding proteins), polyamino acid sequences, and antibody derivatives (e.g., scFvs, scFcs, dual-variable-domains, and antibody derivatives based on the CrossMab approach).

"Percent (%) amino acid sequence identity" with respect to a reference polypeptide sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared. For example, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A.

Antibody "effector functions" refer to those biological activities attributable to the Fc region (a native sequence Fc region or amino acid sequence variant Fc region) of an antibody, and vary with the antibody isotype. Examples of antibody effector functions include: C1q binding and complement dependent cytotoxicity; Fc receptor binding; antibody-dependent cell-mediated cytotoxicity (ADCC); phagocytosis; down regulation of cell surface receptors (e.g., B cell receptors); and B cell activation.

"Binding affinity" as used herein refers to the strength of the non-covalent interactions between a single binding site of a molecule (e.g., a cytokine) and its binding partner (e.g., a cytokine receptor). In some embodiments, the affinity of a binding protein (e.g., a cytokine) can generally be represented by a dissociation constant (Kd). Affinity can be measured by common methods known in the art, including those described herein.

An "isolated" nucleic acid molecule encoding the cytokine polypeptides described herein is a nucleic acid molecule that is identified and separated from at least one contaminant nucleic acid molecule with which it is ordinarily associated in the environment in which it was produced. In some embodiments, the isolated nucleic acid is free of association with all components associated with the production environment. The isolated nucleic acid molecules encoding the polypeptides and cytokine polypeptides herein is in a form other than in the form or setting in which it is found in nature. Isolated nucleic acid molecules therefore are distinguished from nucleic acid encoding the polypeptides and cytokine polypeptides herein existing naturally in cells.

The term "pharmaceutical formulation" refers to a preparation that is in such form as to permit the biological activity of the active ingredient to be effective, and that contains no additional components that are unacceptably toxic to a subject to which the formulation would be administered. Such formulations are sterile.

"Carriers" as used herein include pharmaceutically acceptable carriers, excipients, or stabilizers that are non-toxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™.

As used herein, the term "treatment" refers to clinical intervention designed to alter the natural course of the individual or cell being treated during the course of clinical pathology. Desirable effects of treatment include decreasing the rate of disease progression, ameliorating or palliating the disease state, and remission or improved prognosis. An individual is successfully "treated", for example, if one or more symptoms associated with a disorder (e.g., a neoplastic disease) are mitigated or eliminated. For example, an individual is successfully "treated" if treatment results in increasing the quality of life of those suffering from a disease, decreasing the dose of other medications required for treating the disease, reducing the frequency of recurrence of the disease, lessening severity of the disease, delaying the development or progression of the disease, and/or prolonging survival of individuals.

As used herein, "in conjunction with" or "in combination with" refers to administration of one treatment modality in addition to another treatment modality. As such, "in conjunction with" or "in combination with" refers to administration of one treatment modality before, during or after administration of the other treatment modality to the individual.

As used herein, the term "prevention" includes providing prophylaxis with respect to occurrence or recurrence of a disease in an individual. An individual may be predisposed to, susceptible to a disorder, or at risk of developing a disorder, but has not yet been diagnosed with the disorder. In some embodiments, masked cytokines described herein are used to delay development of a disorder.

As used herein, an individual "at risk" of developing a disorder may or may not have detectable disease or symptoms of disease, and may or may not have displayed detectable disease or symptoms of disease prior to the treatment methods described herein. "At risk" denotes that an individual has one or more risk factors, which are measurable parameters that correlate with development of the disease, as known in the art. An individual having one or more of these risk factors has a higher probability of developing the disorder than an individual without one or more of these risk factors.

An "effective amount" refers to at least an amount effective, at dosages and for periods of time necessary, to achieve the desired or indicated effect, including a therapeutic or prophylactic result. An effective amount can be provided in one or more administrations. A "therapeutically effective amount" is at least the minimum concentration required to effect a measurable improvement of a particular disorder. A therapeutically effective amount herein may vary according to factors such as the disease state, age, sex, and weight of the patient, and the ability of the antibody to elicit a desired response in the individual. A therapeutically effective amount may also be one in which any toxic or detrimental effects of the masked cytokine are outweighed by the therapeutically beneficial effects. A "prophylactically effective amount" refers to an amount effective, at the dosages and for periods of time necessary, to achieve the desired prophylactic result. Typically, but not necessarily, since a prophylactic dose is used in subjects prior to or at the earlier stage of disease, the prophylactically effective amount can be less than the therapeutically effective amount.

"Chronic" administration refers to administration of the medicament(s) in a continuous as opposed to acute mode, so as to main the initial therapeutic effect (activity) for an extended period of time. "Intermittent" administration is treatment that is not consecutively done without interruption, but rather is cyclic in nature.

As used herein, an "individual" or a "subject" is a mammal. A "mammal" for purposes of treatment includes humans, domestic and farm animals, and zoo, sports, or pet animals, such as dogs, horses, rabbits, cattle, pigs, hamsters, gerbils, mice, ferrets, rats, cats, etc. In some embodiments, the individual or subject is human

VII. EXEMPLARY EMBODIMENTS

Among the provided embodiments are:
1. A masked cytokine comprising:
   a) a masking moiety; and
   b) a cytokine or functional fragment thereof,
   wherein the masking moiety is linked to the cytokine or functional fragment thereof via a first linker.
2. The masked cytokine of embodiment 1, further comprising a half-life extension domain that is linked to either the masking moiety or the cytokine or functional fragment thereof.
3. The masked cytokine of embodiment 2, wherein the half-life extension domain is linked to either the masking moiety or the cytokine or functional fragment thereof via a second linker.
4. The masked cytokine of embodiment 2 or embodiment 3, wherein:
   i) the masked cytokine comprises in an N to C-terminal or in a C to N-terminal direction: a) the masking moiety; b) the first linker; c) the cytokine or functional fragment thereof; and d) the half-life extension domain;
   ii) the masked cytokine comprises in an N to C-terminal or in a C to N-terminal direction: a) the masking moiety; b) the first linker; c) the cytokine or functional fragment thereof; d) the second linker and e) the half-life extension domain;
   iii) the masked cytokine comprises in an N to C-terminal or in a C to N-terminal direction: a) the cytokine or functional fragment thereof; b) the first linker; c) the masking moiety; and d) the half-life extension domain; or
   iv) the masked cytokine comprises in an N to C-terminal or in a C to N-terminal direction: a) the cytokine or functional fragment thereof; b) the first linker; c) the masking moiety; d) the second linker; and e) the half-life extension domain.
5. The masked cytokine of any one of embodiments 1-4, wherein the cytokine or functional fragment thereof is an IL-2 polypeptide or functional fragment thereof.
6. The masked cytokine of embodiment 5, wherein the IL-2 polypeptide or functional fragment thereof comprises an amino acid sequence selected from the group consisting of SEQ ID NOs: 1-8, 160, 230, 243-251, 260, 775-792, and 813-822.

7. The masked cytokine of embodiment 5, wherein the IL-2 polypeptide or functional fragment thereof comprises an amino acid sequence produced by introducing one or more amino acid substitutions into the amino acid sequence of the IL-2 polypeptide or functional fragment thereof that reduces the affinity of the IL-2 polypeptide or functional fragment thereof for CD25 (IL-2Rα).
8. The masked cytokine of embodiment 7, wherein the amino acid sequence is produced by introducing one or more of the following amino acid substitutions into any one of SEQ ID NOs: 1-8, 160, 243-251, 260, 775-792, and 813-822: R38A, F42A, F42K, F42E, K43A, Y45A, Y45N, Y45R, E62A, E62R, E62S, and L72G.
9. The masked cytokine of embodiment 5, wherein the IL-2 polypeptide or functional fragment thereof comprises an amino acid sequence produced by introducing one or more amino acid substitutions into the amino acid sequence of the IL-2 polypeptide or functional fragment thereof that increases the affinity of the IL-2 polypeptide or functional fragment thereof for IL-2Rβ or IL-2Rγ.
10. The masked cytokine of embodiment 9, wherein the amino acid sequence is produced by introducing one or more of the following amino acid substitutions into any one of SEQ ID NOs: 1-8, 160, 243-251, 260, 775-792, and 813-822: H16I, L18C, D20A, D20L, D20F, N29L, L80F, R81D, L85V, I86V, and I92F.
11. The masked cytokine of embodiment 7 or embodiment 8, wherein the amino acid sequence is produced by further introducing one or more amino acid substitutions that increase the affinity of the IL-2 polypeptide or functional fragment thereof for IL-2Rβ or IL-2Rγ.
12. The masked cytokine of embodiment 11, wherein the one or more amino acid substitutions that increase the affinity of the IL-2 polypeptide or functional fragment thereof for IL-2Rβ or IL-2Rγ is selected from the group consisting of H16I, L18C, D20A, D20L, D20F, N29L, L80F, R81D, L85V, I86V, and I92F.
13. The masked cytokine of embodiment 5, wherein the IL-2 polypeptide or functional fragment thereof comprises an amino acid sequence produced by introducing one or more amino acid substitutions into the amino acid sequence of the IL-2 polypeptide or functional fragment thereof that stabilizes the IL-2 polypeptide or functional fragment thereof.
14. The masked cytokine of embodiment 13, wherein the amino acid sequence is produced by introducing one of the following amino acid substitutions into any one of SEQ ID NOs: 1-8, 160, 243-251, 260, 775-792, and 813-822: C125S, C125A, and C125G.
15. The masked cytokine of any one of embodiments 7-12, wherein the amino acid sequence is produced by further introducing one or more amino acid substitutions that stabilize the IL-2 polypeptide or functional fragment thereof.
16. The masked cytokine of embodiment 15, wherein the one or more amino acid substitutions that stabilize the IL-2 polypeptide or functional fragment thereof is the amino acid substitution C125S, C125A, or C125G.
17. The masked cytokine of any one of embodiments 5-16, wherein the masking moiety comprises an amino acid sequence selected from the group consisting of SEQ ID NOs: 9, 10, 161-165, 187-218, 221-229, 231, 261, 826 and 827.
18. The masked cytokine of any one of embodiments 1-4, wherein the cytokine or functional fragment thereof is an IL-15 polypeptide or functional fragment thereof.

19. The masked cytokine of embodiment 18, wherein the IL-15 polypeptide or functional fragment thereof comprises the amino acid sequence of SEQ ID NO: 167.

20. The masked cytokine of embodiment 18 or embodiment 19, wherein the masking moiety comprises an amino acid sequence selected from the group consisting of SEQ ID NOs: 10, 161-165, 219-229, 232-234, 261, and 823-827.

21. The masked cytokine of embodiment 18 or embodiment 19, wherein the masking moiety comprises an amino acid sequence produced by introducing one or more of the following amino acid substitutions into the amino acid sequence of any one of SEQ ID NOs: 232-234, and 823-825: R24A, R26A, K34A, S40A, L42A, and P67A.

22. The masked cytokine of any one of embodiments 2-21, wherein the half-life extension domain is an antibody or fragment thereof.

23. The masked cytokine of embodiment 22, wherein the antibody or fragment thereof comprises either a heavy chain polypeptide or a light chain polypeptide.

24. The masked cytokine of embodiment 23, wherein the heavy chain polypeptide comprises an amino acid sequence selected from the group consisting of SEQ ID NOs: 158, 168, and 169.

25. The masked cytokine of embodiment 23, wherein the heavy chain polypeptide comprises one or more amino acid substitutions altering effector function.

26. The masked cytokine of embodiment 25, wherein the heavy chain polypeptide:

a) is an IgG1 heavy chain polypeptide and comprises the amino acid substitution(s):

i) N297A, N297G, or N297Q;
ii) L234A and L235A;
iii) C220S, C226S, C229S, and P238S;
iv) C226S, C229S, E233P, L234V, and L235A;
v) L234F, L235E, and P331S;
vi) S267E and L328F;
vii) D265A;
viii) L234A, L235A, and P329G;

b) is an IgG2 heavy chain polypeptide and comprises the amino acid substitution(s):

i) V234A and G237A;
ii) H268Q, V309L, A330S, and A331S; or
iii) V234A, G237A, P238S, H268A, V309L, A330S, and P331S; or e) is an IgG4 heavy chain polypeptide and comprises the amino acid substitution(s):

i) L235A, G237A, and E318A;
ii) S228P, L234A, and L235A;
iii) H268Q, V309L, A330S, and P331S; or
iv) S228P and L235A, numbered according to the Kabat EU numbering system.

27. The masked cytokine of embodiment 25, wherein the heavy chain polypeptide comprises one or more amino acid substitutions enhancing effector function.

28. The masked cytokine of embodiment 27, wherein the heavy chain polypeptide is an IgG1 heavy chain polypeptide and comprises the amino acid substitution(s):

a) S298A, E333A, and K334A;
b) S239D and I332E;
c) S239D, A330L, and I332E;
d) P247I and A339D or A339Q;
e) D280H and K290S;
f) D280H, K290S, and either S298D or S298V;
g) F243L, R292P, and Y300L;
h) F243L, R292P, Y300L, and P396L;
i) F243L, R292P, Y300L, V305I, and P396L;
j) G236A, S239D, and I332E;
k) K326A and E333A;
l) K326W and E333S;
m) K290E, S298G, and T299A;
n) K290E, S298G, T299A, and K326E;
o) K290N, S298G, and T299A;
p) K290N, S298G, T299A, and K326E;
q) K334V;
r) L235S, S239D, and K334V;
s) K334V and Q331M, S239D, F243V, E294L, or S298T;
t) E233L, Q311M, and K334V;
u) L234I, Q311M, and K334V;
v) K334V and S298T, A330M, or A330F;
w) K334V, Q311M, and either A330M or A330F;
x) K334V, S298T, and either A330M or A330F;
y) K334V, S239D, and either A330M or S298T;
z) L234Y, Y296W, and K290Y, F243V, or E294L;
aa) Y296W and either L234Y or K290Y;
ab) S239D, A330S, and I332E,
ac) V264I;
ad) F243L and V264I;
ae) L328M;
af) I332E;
ag) L328M and I332E;
ah) V264I and I332E;
ai) S239E and I332E;
aj) S239Q and I332E;
ak) S239E;
al) A330Y;
am) I332D;
an) L328I and I332E;
ao) L328Q and I332E;
ap) V264T;
aq) V240I;
ar) V266I;
as) S239D;
at) S239D and I332D;
au) S239D and I332N;
av) S239D and I332Q;
aw) S239E and I332D;
ax) S239E and I332N;
ay) S239E and I332Q;
az) S239N and I332D;
ba) S239N and I332E;
bb) S239Q and I332D;
bc) A330Y and I332E;
bd) V2641, A330Y, and I332E;
be) A330L and I332E;
bf) V264I, A330L, and I332E;
bg) L234E, L234Y, or L234I;
bh) L235D, L235S, L235Y, or L235I;
bi) S239T;
bj) V240M;
bk) V264Y;
bl) A330I;
bm) N325T;
bn) I332E and L328D, L328V, L328T, or L328I;
bo) V264I, I332E, and either S239E or S239Q;
bp) S239E, V264I, A330Y, and I332E;
bq) A330Y, I332E, and either S239D or S239N;
br) A330L, I332E, and either S239D or S239N;
bs) V264I, S298A, and I332E;
bt) S298A, I332E, and either S239D or S239N;
bu) S239D, V264I, and I332E;
by) S239D, V264I, S298A, and I332E;
bw) S239D, V264I, A330L, and I332E;
bx) S239D, I332E, and A330I;
by) P230A;

bz) P230A, E233D, and I332E;
ca) E272Y;
cb) K274T, K274E, K274R, K274L, or K274Y;
cd) F275W;
ce) N276L;
cf) Y278T;
cg) V302I;
ch) E318R;
ci) S324D, S324I or S324V;
cj) K326I or K326T;
ck) T335D, T335R, or T335Y;
cl) V240I and V266I;
cm) S239D, A330Y, I332E, and L234I;
cn) S239D, A330Y, I332E, and L235D;
co) S239D, A330Y, I332E, and V240I;
cp) S239D, A330Y, I332E, and V264T; or
cq) S239D, A330Y, I332E, and either K326E or K326T, numbered according to the Kabat EU numbering system.

29. The masked cytokine of embodiment 23, wherein the light chain polypeptide comprises the amino acid sequence of SEQ ID NO: 157 or 170.

30. The masked cytokine of embodiment 22, wherein the antibody or fragment thereof is a Fragment crystallizable domain (Fc domain) or fragment thereof.

31. The masked cytokine of embodiment 30, wherein the Fc domain or fragment thereof comprises one or more amino acid substitutions altering effector function.

32. The masked cytokine of embodiment 31, wherein the Fc domain or functional fragment thereof:
a) is an IgG1 Fc domain or functional fragment thereof and comprises the amino acid substitution(s):
  i) N297A, N297G, or N297Q;
  ii) L234A and L235A;
  iii) C220S, C226S, C229S, and P238S;
iv) C226S, C229S, E233P, L234V, and L235A;
v) L234F, L235E, and P331S;
vi) S267E and L328F;
vii) D265A;
viii) L234A, L235A, and P329G;

b) is an IgG2 Fc domain or functional fragment thereof and comprises the amino acid substitution(s):
i) V234A and G237A;
ii) H268Q, V309L, A330S, and A331S; or
iii) V234A, G237A, P238S, H268A, V309L, A330S, and P331S; or e) is an IgG4 Fc domain or functional fragment thereof and comprises the amino acid substitution(s):
i) L235A, G237A, and E318A;
ii) S228P, L234A, and L235A;
iii) H268Q, V309L, A330S, and P331S; or
iv) S228P and L235A, numbered according to the Kabat EU numbering system.

33. The masked cytokine of embodiment 31, wherein the Fc domain or functional fragment thereof comprises one or more amino acid substitutions enhancing effector function.

34. The masked cytokine of embodiment 33, wherein the Fc domain or functional fragment thereof is an IgG1 Fc domain or functional fragment thereof and comprises the amino acid substitution(s):
a) S298A, E333A, and K334A;
b) S239D and I332E;
c) S239D, A330L, and I332E;
d) P247I and A339D or A339Q;
e) D280H and K290S;
f) D280H, K290S, and either S298D or S298V;
g) F243L, R292P, and Y300L;
h) F243L, R292P, Y300L, and P396L;
i) F243L, R292P, Y300L, V305I, and P396L;
j) G236A, S239D, and I332E;
k) K326A and E333A;
l) K326W and E333S;
m) K290E, S298G, and T299A;
n) K290E, S298G, T299A, and K326E;
o) K290N, S298G, and T299A;
p) K290N, S298G, T299A, and K326E;
q) K334V;
r) L235S, S239D, and K334V;
s) K334V and Q331M, S239D, F243V, E294L, or S298T;
t) E233L, Q311M, and K334V;
u) L234I, Q311M, and K334V;
v) K334V and S298T, A330M, or A330F;
w) K334V, Q311M, and either A330M or A330F;
x) K334V, S298T, and either A330M or A330F;
y) K334V, S239D, and either A330M or S298T;
z) L234Y, Y296W, and K290Y, F243V, or E294L;
aa) Y296W and either L234Y or K290Y;
ab) S239D, A330S, and I332E,
ac) V264I;
ad) F243L and V264I;
ae) L328M;
af) I332E;
ag) L328M and I332E;
ah) V264I and I332E;
ai) S239E and I332E;
aj) S239Q and I332E;
ak) S239E;
al) A330Y;
am) I332D;
an) L328I and I332E;
ao) L328Q and I332E;
ap) V264T;
aq) V240I;
ar) V266I;
as) S239D;
at) S239D and I332D;
au) S239D and I332N;
av) S239D and I332Q;
aw) S239E and I332D;
ax) S239E and I332N;
ay) S239E and I332Q;
az) S239N and I332D;
ba) S239N and I332E;
bb) S239Q and I332D;
bc) A330Y and I332E;
bd) V264I, A330Y, and I332E;
be) A330L and I332E;
bf) V264I, A330L, and I332E;
bg) L234E, L234Y, or L234I;
bh) L235D, L235S, L235Y, or L235I;
bi) S239T;
bj) V240M;
bk) V264Y;
bl) A330I;
bm) N325T;
bn) I332E and L328D, L328V, L328T, or L328I;
bo) V264I, I332E, and either S239E or S239Q;
bp) S239E, V264I, A330Y, and I332E;
bq) A330Y, I332E, and either S239D or S239N;
br) A330L, I332E, and either S239D or S239N;
bs) V264I, S298A, and I332E;
bt) S298A, I332E, and either S239D or S239N;
bu) S239D, V264I, and I332E;
by) S239D, V264I, S298A, and I332E;
bw) S239D, V264I, A330L, and I332E;

bx) S239D, I332E, and A330I;
by) P230A;
bz) P230A, E233D, and I332E;
ca) E272Y;
cb) K274T, K274E, K274R, K274L, or K274Y;
cd) F275W;
ce) N276L;
cf) Y278T;
cg) V302I;
ch) E318R;
ci) S324D, S324I or S324V;
cj) K326I or K326T;
ck) T335D, T335R, or T335Y;
cl) V240I and V266I;
cm) S239D, A330Y, I332E, and L234I;
cn) S239D, A330Y, I332E, and L235D;
co) S239D, A330Y, I332E, and V240I;
cp) S239D, A330Y, I332E, and V264T; or
cq) S239D, A330Y, I332E, and either K326E or K326T, numbered according to the Kabat EU numbering system.

35. The masked cytokine of any one of embodiments 30-32, wherein the Fc domain or fragment thereof comprises the amino acid sequence of SEQ ID NO: 154.

36. The masked cytokine of any one of embodiments 2-21, wherein the half-life extension domain is an albumin polypeptide or fragment thereof.

37. The masked cytokine of embodiment 36, wherein the albumin polypeptide or fragment thereof comprises the amino acid sequence of SEQ ID NO: 171.

38. The masked cytokine of any one of embodiments 2-21, wherein the half-life extension domain is an albumin-binding protein or fragment thereof.

39. The masked cytokine of embodiment 38, wherein the albumin-binding protein or fragment thereof comprises an amino acid sequence selected from the group consisting of SEQ ID NOs: 172-174 and 252-259.

40. The masked cytokine of any one of embodiments 2-21, wherein the half-life extension domain is an IgG-binding protein or fragment thereof.

41. The masked cytokine of embodiment 40, wherein the IgG binding protein or functional fragment thereof comprises an amino acid sequence selected from the group consisting of SEQ ID NOs: 175-186.

42. The masked cytokine of any one of embodiments 2-21, wherein the half-life extension domain is a polyamino acid sequence.

43. The masked cytokine of embodiment 42, wherein the polyamino acid sequence is a PAS polypeptide or an XTEN polypeptide.

44. The masked cytokine of embodiment 43, wherein the PAS polypeptide comprises at least 25, at least 50, at least 100, at least 150, at least 200, at least 250, at least 300, at least 400, at least 500, at least 600, at least 700, at least 800, at least 900, at least 1000, at least 1100, at least 1200, at least 1300, at least 1500, at least 2000, at least 2500, or at least 3000 amino acid residues, wherein each amino acid residue is either a proline or an alanine residue.

45. The masked cytokine of embodiment 43, wherein the PAS polypeptide comprises at least 25, at least 50, at least 100, at least 150, at least 200, at least 250, at least 300, at least 400, at least 500, at least 600, at least 700, at least 800, at least 900, at least 1000, at least 1100, at least 1200, at least 1300, at least 1500, at least 2000, at least 2500, or at least 3000 amino acid residues, wherein each amino acid residue is selected from the group consisting of a proline, an alanine, and a serine residue.

46. The masked cytokine of embodiment 43, wherein the XTEN polypeptide comprises an amino acid sequence of about 25 to about 500, about 200 to about 1000, about 500 to about 1500, about 1000 to about 2000, or about 1500 to about 3000 amino acid residues, wherein at least about 70%, 75%, 80%, or 85% of the amino acid sequence consists of non-overlapping sequence motifs where each of the motifs has 5 to 100 amino acid residues, 5 to 50 amino acids residues, or 9 to 36 amino acid residues, and wherein at least 90%, at least 91%, at least 92%, at least 93%, at least 94%, at least 95%, at least 96%, at least 97%, at least 98%, at least 99%, or 100% of each of the motifs consists of four, five, or six types of amino acid residues selected from the group consisting of glycine (G), alanine (A), serine (S), threonine (T), glutamate (E) and proline (P), and wherein the content of any one amino acid type in the full-length XTEN polypeptide does not exceed about 40%, about 35%, about 30%, about 25%, about 15%, about 10%, or about 8%.

47. The masked cytokine of any one of embodiments 1-46, wherein the masked cytokine further comprises one or more PEG polymer chains attached to the masked cytokine.

48. The masked cytokine of embodiment 47, wherein the one or more PEG polymer chains are attached to the cytokine or functional fragment thereof and/or the half-life extension domain.

49. The masked cytokine of any one of embodiments 1-48, wherein the masked cytokine is modified, or is further modified, by altering the amino acid sequence of the masked cytokine such that one or more additional N-linked and/or O-linked glycosylation sites are created.

50. The masked cytokine of embodiment 49, wherein the masked cytokine is modified, or is further modified, by altering the amino acid sequence of the masked cytokine such that one or more additional asparagine-X-serine (N-X-S) and/or asparagine-X-threonine (N-X-T) tripeptide sequence(s) is/are introduced into the amino acid sequence of the masked cytokine, wherein X is any amino acid except proline.

51. The masked cytokine of embodiment 49 or embodiment 50, wherein the masked cytokine is modified, or is further modified, by altering the amino acid sequence of the masked cytokine such that one or more additional serine or threonine residues is/are introduced into the amino acid sequence of the masked cytokine.

52. The masked cytokine of any one of embodiments 1-51, wherein the first linker comprises a first cleavable peptide.

53. The masked cytokine of any one of embodiments 1-52, where the first linker comprises a first N-terminal spacer domain and/or a first C-terminal spacer domain.

54. The masked cytokine of embodiment 53, wherein the first linker comprises:
  a) the first N-terminal spacer domain, the first cleavable peptide, and the first C-terminal spacer domain;
  b) the first N-terminal spacer domain and the first cleavable peptide;
  c) the first N-terminal spacer domain and the first C-terminal spacer domain;
  d) the first cleavable peptide and the first C-terminal spacer domain;
  e) the first N-terminal spacer domain; or
  f) the first C-terminal spacer domain.

55. The masked cytokine of embodiment 53 or embodiment 54, wherein the first cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555.

56. The masked cytokine of any one of embodiments 53-55, wherein the first N-terminal spacer domain comprises an amino acid sequence selected from the group consisting of SEQ ID NOs: 20-95, 235, 268, 269, 303-305, 323-338, 340, 341, 727, 794, and 799.

57. The masked cytokine of any one of embodiments 53-55, wherein the first C-terminal spacer domain comprises an amino acid sequence selected from the group consisting of SEQ ID NOs: 20-95, 235, 268, 269, 303-305, 323-338, 340, 341, 727, 794, and 799.

58. The masked cytokine of embodiment 53 or embodiment 54, wherein the first cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

59. The masked cytokine of embodiment 58, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

60. The masked cytokine of any one of embodiments 1-59, wherein the first linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812.

61. The masked cytokine of any one of embodiments 3-60, wherein the second linker comprises a second cleavable peptide.

62. The masked cytokine of any one of embodiments 3-61, wherein the second linker comprises a second N-terminal spacer domain and/or a second C-terminal spacer domain.

63. The masked cytokine of embodiment 62, wherein the second linker comprises:

a) the second N-terminal spacer domain, the second cleavable peptide, and second first C-terminal spacer domain;

b) the second N-terminal spacer domain and the second cleavable peptide;

c) the second N-terminal spacer domain and the second C-terminal spacer domain;

d) the second cleavable peptide and the second C-terminal spacer domain;

e) the second N-terminal spacer domain; or f) the second C-terminal spacer domain.

64. The masked cytokine of any one of embodiments 61-63, wherein the second cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555.

65. The masked cytokine of any one of embodiments 62-64, wherein the second N-terminal spacer domain comprises an amino acid sequence selected from the group consisting of SEQ ID NOs: 20-95, 235, 268, 269, 303-305, 323-338, 340, 341, 727, 794, and 799.

66. The masked cytokine of any one of embodiments 62-65, wherein the second C-terminal spacer domain comprises an amino acid sequence selected from the group consisting of SEQ ID NOs: 20-95, 235, 268, 269, 303-305, 323-338, 340, 341, 727, 794, and 799.

67. The masked cytokine of embodiment 62 or embodiment 63, wherein the second cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

68. The masked cytokine of embodiment 67, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

69. The masked cytokine of any one of embodiments 3-68, wherein the second linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812.

70. A masked cytokine comprising:

a) a first masking moiety;

b) a cytokine or functional fragment thereof, wherein the first masking moiety is linked to the cytokine or functional fragment thereof via a first linker; and c) a second masking moiety, wherein the second masking moiety is linked to the cytokine or functional fragment thereof via a second linker.

71. The masked cytokine of embodiment 70, further comprising a half-life extension domain that is linked to either the first masking moiety or the second masking moiety.

72. The masked cytokine of embodiment 71, wherein the half-life extension domain is linked to either the first masking moiety or the second masking moiety via a third linker.

73. The masked cytokine of embodiment 71 or embodiment 72, wherein:

i) the masked cytokine comprises in an N to C-terminal or in a C to N-terminal direction: a) the first masking moiety; b) the first linker; c) the cytokine or functional fragment thereof; d) the second linker; e) the second masking moiety; and f) the half-life extension domain;

ii) the masked cytokine comprises in an N to C-terminal or in a C to N-terminal direction: a) the first masking moiety; b) the first linker; c) the cytokine or functional fragment thereof; d) the second linker; e) the second masking moiety; f) the third linker; and g) the half-life extension domain;

iii) the masked cytokine comprises in an N to C-terminal or in a C to N-terminal direction: a) the second masking moiety; b) the second linker; c) the cytokine or functional fragment thereof; d) the first linker; e) the first masking moiety; and f) the half-life extension domain; or iv) the masked cytokine comprises in an N to C-terminal or in a C to N-terminal direction: a) the second masking moiety; b) the second linker; c) the cytokine or functional fragment thereof; d) the first linker; e) the first masking moiety; f) the third linker; and g) the half-life extension domain.

74. The masked cytokine of any one of embodiments 70-73, wherein the cytokine or functional fragment thereof is an IL-2 polypeptide or functional fragment thereof.

75. The masked cytokine of embodiment 74, wherein the IL-2 polypeptide or functional fragment thereof comprises:
   a) an amino acid sequence selected from the group consisting of SEQ ID NOs: 1-8, 160, 230, 243-251, 260, 775-792, and 813-822; or
   b) an amino acid sequence produced by introducing one or more of the following amino acid substitutions into any one of SEQ ID NOs: 1-8, 160, 243-251, 260, 775-792, and 813-822: H16I, L18C, D20A, D20L, D20F, N29L, R38A, F42A, F42K, F42E, F43A, Y45A, Y45N, Y45R, E62A, E62R, E62S, L72G, L80F, R81D, L85V, I86V, I92F, and C125S.

76. The masked cytokine of embodiment 74 or embodiment 75, wherein the first masking moiety comprises an amino acid sequence selected from the group consisting of SEQ ID NOs: 9, 10, 161-165, 187-218, 221-229, 231, and 261, and the second masking moiety comprises an amino acid sequence selected from the group consisting of SEQ ID NOs: 9, 10, 161-165, 187-218, 221-229, 231, and 261, and wherein the amino acid sequence of the first masking moiety and the second masking moiety are different.

77. The masked cytokine of any one of embodiments 74-76, wherein:
   a) the first masking moiety comprises the amino acid sequence of SEQ ID NO: 9 or 231, and the second masking moiety comprises an amino acid sequence selected from the group consisting of SEQ ID NOs: 10, 161-165, 187-218, 221-226, and 261; or
   b) the first masking moiety comprises an amino acid sequence selected from the group consisting of SEQ ID NOs: 10, 161-165, 187-218, 221-226, and 261, and the second masking moiety comprises the amino acid sequence of SEQ ID NO: 9 or 231.

78. The masked cytokine of any one of embodiments 70-73, wherein the cytokine or functional fragment thereof is an IL-15 polypeptide or functional fragment thereof.

79. The masked cytokine of embodiment 78, wherein the IL-15 polypeptide or functional fragment thereof comprises the amino acid sequence of SEQ ID NO: 167.

80. The masked cytokine of embodiment 78 or embodiment 79, wherein:
   a) the first masking moiety comprises an amino acid sequence selected from the group consisting of SEQ ID NOs: 232-234, and 823-825, and the second masking moiety comprises an amino acid sequence selected from the group consisting of SEQ ID NOs: 10, 161-165, 219-229, and 261;
   b) the first masking moiety comprises an amino acid sequence selected from the group consisting of SEQ ID NOs: 10, 161-165, 219-229, and 261, and the second masking moiety comprises an amino acid sequence selected from the group consisting of SEQ ID NOs: 232-234, and 823-825;
   c) the first masking moiety comprises an amino acid sequence produced by introducing one or more of the following amino acid substitutions into the amino acid sequence of any one of SEQ ID NOs: 232-234, and 823-825: R24A, R26A, K34A, S40A, L42A, and P67A, and the second masking moiety comprises an amino acid sequence selected from the group consisting of SEQ ID NOs: 10, 161-165, 219-229, and 261; or
   d) the first masking moiety comprises an amino acid sequence selected from the group consisting of SEQ ID NOs: 10, 161-165, 219-229, and 261, and the second masking moiety comprises an amino acid sequence produced by introducing one or more of the following amino acid substitutions into the amino acid sequence of any one of SEQ ID NOs: 232-234, and 823-825: R24A, R26A, K34A, S40A, L42A, and P67A.

81. The masked cytokine of any one of embodiments 71-80, wherein the half-life extension domain is an antibody or fragment thereof.

82. The masked cytokine of embodiment 81, wherein the antibody or fragment thereof comprises either a heavy chain polypeptide or a light chain polypeptide.

83. The masked cytokine of embodiment 82, wherein the heavy chain polypeptide comprises an amino acid sequence selected from the group consisting of SEQ ID NOs: 158, 168, and 169.

84. The masked cytokine of embodiment 82, wherein the heavy chain polypeptide comprises one or more amino acid substitutions altering effector function.

85. The masked cytokine of embodiment 84, wherein the heavy chain polypeptide:
   a) is an IgG1 heavy chain polypeptide and comprises the amino acid substitution(s):
      i) N297A, N297G, or N297Q;
      ii) L234A and L235A;
      iii) C220S, C226S, C229S, and P238S;
      iv) C226S, C229S, E233P, L234V, and L235A;
      v) L234F, L235E, and P331S;
      vi) S267E and L328F;
      vii) D265A;
      viii) L234A, L235A, and P329G;
   b) is an IgG2 heavy chain polypeptide and comprises the amino acid substitution(s):
      i) V234A and G237A;
      ii) H268Q, V309L, A330S, and A331S; or
      iii) V234A, G237A, P238S, H268A, V309L, A330S, and P331S; or
   e) is an IgG4 heavy chain polypeptide and comprises the amino acid substitution(s):
      i) L235A, G237A, and E318A;
      ii) S228P, L234A, and L235A;
      iii) H268Q, V309L, A330S, and P331S; or
      iv) S228P and L235A, numbered according to the Kabat EU numbering system.

86. The masked cytokine of embodiment 84, wherein the heavy chain polypeptide comprises one or more amino acid substitutions enhancing effector function.

87. The masked cytokine of embodiment 86, wherein the heavy chain polypeptide is an IgG1 heavy chain polypeptide and comprises the amino acid substitution(s):
   a) S298A, E333A, and K334A;
   b) S239D and I332E;
   c) S239D, A330L, and I332E;
   d) P247I and A339D or A339Q;
   e) D280H and K290S;
   f) D280H, K290S, and either S298D or S298V;
   g) F243L, R292P, and Y300L;
   h) F243L, R292P, Y300L, and P396L;
   i) F243L, R292P, Y300L, V305I, and P396L;
   j) G236A, S239D, and I332E;
   k) K326A and E333A;
   l) K326W and E333S;
   m) K290E, S298G, and T299A;
   n) K290E, S298G, T299A, and K326E;
   o) K290N, S298G, and T299A;
   p) K290N, S298G, T299A, and K326E;
   q) K334V;

r) L235S, S239D, and K334V;
s) K334V and Q331M, S239D, F243V, E294L, or S298T;
t) E233L, Q311M, and K334V;
u) L234I, Q311M, and K334V;
v) K334V and S298T, A330M, or A330F;
w) K334V, Q311M, and either A330M or A330F;
x) K334V, S298T, and either A330M or A330F;
y) K334V, S239D, and either A330M or S298T;
z) L234Y, Y296W, and K290Y, F243V, or E294L;
aa) Y296W and either L234Y or K290Y;
ab) S239D, A330S, and I332E,
ac) V264I;
ad) F243L and V264I;
ae) L328M;
af) I332E;
ag) L328M and I332E;
ah) V264I and I332E;
ai) S239E and I332E;
aj) S239Q and I332E;
ak) S239E;
al) A330Y;
am) I332D;
an) L328I and I332E;
ao) L328Q and I332E;
ap) V264T;
aq) V240I;
ar) V266I;
as) S239D;
at) S239D and I332D;
au) S239D and I332N;
av) S239D and I332Q;
aw) S239E and I332D;
ax) S239E and I332N;
ay) S239E and I332Q;
az) S239N and I332D;
ba) S239N and I332E;
bb) S239Q and I332D;
bc) A330Y and I332E;
bd) V264I, A330Y, and I332E;
be) A330L and I332E;
bf) V264I, A330L, and I332E;
bg) L234E, L234Y, or L234I;
bh) L235D, L235S, L235Y, or L235I;
bi) S239T;
bj) V240M;
bk) V264Y;
bl) A330I;
bm) N325T;
bn) I332E and L328D, L328V, L328T, or L328I;
bo) V264I, I332E, and either S239E or S239Q;
bp) S239E, V264I, A330Y, and I332E;
bq) A330Y, I332E, and either S239D or S239N;
br) A330L, I332E, and either S239D or S239N;
bs) V264I, S298A, and I332E;
bt) S298A, I332E, and either S239D or S239N;
bu) S239D, V264I, and I332E;
by) S239D, V264I, S298A, and I332E;
bw) S239D, V264I, A330L, and I332E;
bx) S239D, I332E, and A330I;
by) P230A;
bz) P230A, E233D, and I332E;
ca) E272Y;
cb) K274T, K274E, K274R, K274L, or K274Y;
cd) F275W;
ce) N276L;
cf) Y278T;
cg) V302I;
ch) E318R;
ci) S324D, S324I or S324V;
cj) K326I or K326T;
ck) T335D, T335R, or T335Y;
cl) V240I and V266I;
cm) S239D, A330Y, I332E, and L234I;
cn) S239D, A330Y, I332E, and L235D;
co) S239D, A330Y, I332E, and V240I;
cp) S239D, A330Y, I332E, and V264T; or
cq) S239D, A330Y, I332E, and either K326E or K326T, numbered according to the Kabat EU numbering system.

88. The masked cytokine of embodiment 82, wherein the light chain polypeptide comprises the amino acid sequence of SEQ ID NO: 157 or 170.

89. The masked cytokine of embodiment 81, wherein the antibody or fragment thereof is a Fragment crystallizable domain (Fc domain) or fragment thereof.

90. The masked cytokine of embodiment 89, wherein the Fc domain or fragment thereof comprises one or more amino acid substitutions altering effector function.

91. The masked cytokine of embodiment 90, wherein the Fc domain or fragment thereof:

a) is an IgG1 Fc domain or fragment thereof and comprises the amino substitution(s):
i) N297A, N297G, or N297Q;
ii) L234A and L235A;
iii) C220S, C226S, C229S, and P238S;
iv) C226S, C229S, E233P, L234V, and L235A;
v) L234F, L235E, and P331S;
vi) S267E and L328F;
vii) D265A;
viii) L234A, L235A, and P329G;

b) is an IgG2 Fc domain or fragment thereof and comprises the amino acid substitution(s):
i) V234A and G237A;
ii) H268Q, V309L, A330S, and A331S; or
iii) V234A, G237A, P238S, H268A, V309L, A330S, and P331S; or e) is an IgG4 Fc domain or fragment thereof and comprises the amino acid substitution(s):
i) L235A, G237A, and E318A;
ii) S228P, L234A, and L235A;
iii) H268Q, V309L, A330S, and P331S; or
iv) S228P and L235A, numbered according to the Kabat EU numbering system.

92. The masked cytokine of embodiment 90, wherein the Fc domain or fragment thereof comprises one or more amino acid substitutions enhancing effector function.

93. The masked cytokine of embodiment 92, wherein the Fc domain or fragment thereof is an IgG1 Fc domain or fragment thereof and comprises the amino acid substitution(s):
a) S298A, E333A, and K334A;
b) S239D and I332E;
c) S239D, A330L, and I332E;
d) P247I and A339D or A339Q;
e) D280H and K290S;
f) D280H, K290S, and either S298D or S298V;
g) F243L, R292P, and Y300L;
h) F243L, R292P, Y300L, and P396L;
i) F243L, R292P, Y300L, V305I, and P396L;
j) G236A, S239D, and I332E;
k) K326A and E333A;
l) K326W and E333S;
m) K290E, S298G, and T299A;
n) K290E, S298G, T299A, and K326E;
o) K290N, S298G, and T299A;

p) K290N, S298G, T299A, and K326E;
q) K334V;
r) L235S, S239D, and K334V;
s) K334V and Q331M, S239D, F243V, E294L, or S298T;
t) E233L, Q311M, and K334V;
u) L234I, Q311M, and K334V;
v) K334V and S298T, A330M, or A330F;
w) K334V, Q311M, and either A330M or A330F;
x) K334V, S298T, and either A330M or A330F;
y) K334V, S239D, and either A330M or S298T;
z) L234Y, Y296W, and K290Y, F243V, or E294L;
aa) Y296W and either L234Y or K290Y;
ab) S239D, A330S, and I332E,
ac) V264I;
ad) F243L and V264I;
ae) L328M;
af) I332E;
ag) L328M and I332E;
ah) V264I and I332E;
ai) S239E and I332E;
aj) S239Q and I332E;
ak) S239E;
al) A330Y;
am) I332D;
an) L328I and I332E;
ao) L328Q and I332E;
ap) V264T;
aq) V240I;
ar) V266I;
as) S239D;
at) S239D and I332D;
au) S239D and I332N;
av) S239D and I332Q;
aw) S239E and I332D;
ax) S239E and I332N;
ay) S239E and I332Q;
az) S239N and I332D;
ba) S239N and I332E;
bb) S239Q and I332D;
bc) A330Y and I332E;
bd) V264I, A330Y, and I332E;
be) A330L and I332E;
bf) V264I, A330L, and I332E;
bg) L234E, L234Y, or L234I;
bh) L235D, L235S, L235Y, or L235I;
bi) S239T;
bj) V240M;
bk) V264Y;
bl) A330I;
bm) N325T;
bn) I332E and L328D, L328V, L328T, or L328I;
bo) V264I, I332E, and either S239E or S239Q;
bp) S239E, V264I, A330Y, and I332E;
bq) A330Y, I332E, and either S239D or S239N;
br) A330L, I332E, and either S239D or S239N;
bs) V264I, S298A, and I332E;
bt) S298A, I332E, and either S239D or S239N;
bu) S239D, V264I, and I332E;
by) S239D, V264I, S298A, and I332E;
bw) S239D, V264I, A330L, and I332E;
bx) S239D, I332E, and A330I;
by) P230A;
bz) P230A, E233D, and I332E;
ca) E272Y;
cb) K274T, K274E, K274R, K274L, or K274Y;
cd) F275W;
ce) N276L;
cf) Y278T;
cg) V302I;
ch) E318R;
ci) S324D, S324I or S324V;
cj) K326I or K326T;
ck) T335D, T335R, or T335Y;
cl) V240I and V266I;
cm) S239D, A330Y, I332E, and L234I;
cn) S239D, A330Y, I332E, and L235D;
co) S239D, A330Y, I332E, and V240I;
cp) S239D, A330Y, I332E, and V264T; or
cq) S239D, A330Y, I332E, and either K326E or K326T,
numbered according to the Kabat EU numbering system.

94. The masked cytokine of embodiment 89, wherein the Fc domain or fragment thereof comprises the amino acid sequence of SEQ ID NO: 154.

95. The masked cytokine of any one of embodiments 71-77, wherein the half-life extension domain is an albumin polypeptide or functional fragment thereof.

96. The masked cytokine of embodiment 95, wherein the albumin polypeptide or functional fragment thereof comprises the amino acid sequence of SEQ ID NO: 171.

97. The masked cytokine of any one of embodiments 71-77, wherein the half-life extension domain is an albumin-binding protein or functional fragment thereof.

98. The masked cytokine of embodiment 97, wherein the albumin-binding protein or functional fragment thereof comprises an amino acid sequence selected from the group consisting of SEQ ID NOs: 172-174 and 252-259.

99. The masked cytokine of any one of embodiments 71-77, wherein the half-life extension domain is an IgG-binding protein or functional fragment thereof.

100. The masked cytokine of embodiment 99, wherein the IgG-binding protein or functional fragment thereof comprises an amino acid sequence selected from the group consisting of SEQ ID NOs: 175-186.

101. The masked cytokine of any one of embodiments 71-77, wherein the half-life extension domain is a polyamino acid sequence.

102. The masked cytokine of embodiment 101, wherein the polyamino acid sequence is a PAS polypeptide or an XTEN polypeptide.

103. The masked cytokine of embodiment 102, wherein the PAS polypeptide comprises at least 25, at least 50, at least 100, at least 150, at least 200, at least 250, at least 300, at least 400, at least 500, at least 600, at least 700, at least 800, at least 900, at least 1000, at least 1100, at least 1200, at least 1300, at least 1500, at least 2000, at least 2500, or at least 3000 amino acid residues, wherein each amino acid residue is either a proline or an alanine residue.

104. The masked cytokine of embodiment 102, wherein the PAS polypeptide comprises at least 25, at least 50, at least 100, at least 150, at least 200, at least 250, at least 300, at least 400, at least 500, at least 600, at least 700, at least 800, at least 900, at least 1000, at least 1100, at least 1200, at least 1300, at least 1500, at least 2000, at least 2500, or at least 3000 amino acid residues, wherein each amino acid residue is selected from the group consisting of a proline, an alanine, and a serine residue.

105. The masked cytokine of embodiment 102, wherein the XTEN polypeptide comprises an amino acid sequence of about 25 to about 500, about 200 to about 1000, about 500 to about 1500, about 1000 to about 2000, or about 1500 to about 3000 amino acid residues, wherein at least about 70%, 75%, 80%, or 85% of the amino acid sequence consists of non-overlapping sequence motifs where each of the motifs has 5 to 100 amino acid residues, 5 to 50 amino acids residues, or 9 to 36 amino acid residues, and wherein at least 90%, at least 91%, at least 92%, at least 93%, at least 94%, at least 95%, at least 96%, at least 97%, at least 98%, at least 99%, or 100% of each of the motifs consists of four, five, or six types of amino acid residues selected from the group consisting of glycine (G), alanine (A), serine (S), threonine (T), glutamate (E) and proline (P), and wherein the content of any one amino acid type in the full-length XTEN polypeptide does not exceed about 40%, about 35%, about 30%, about 25%, about 15%, about 10%, or about 8%.

106. The masked cytokine of any one of embodiments 70-105, wherein the masked cytokine further comprises one or more PEG polymer chains attached to the masked cytokine.

107. The masked cytokine of embodiment 106, wherein the one or more PEG polymer chains are attached to the cytokine or functional fragment thereof and/or the half-life extension domain.

108. The masked cytokine of any one of embodiments 70-107, wherein the masked cytokine is modified, or is further modified, by altering the amino acid sequence of the masked cytokine such that one or more additional N-linked and/or O-linked glycosylation sites are created.

109. The masked cytokine of embodiment 108, wherein the masked cytokine is modified, or is further modified, by altering the amino acid sequence of the masked cytokine such that one or more additional asparagine-X-serine (N-X-S) and/or asparagine-X-threonine (N-X-T) tripeptide sequence(s) is/are introduced into the amino acid sequence of the masked cytokine, wherein X is any amino acid except proline.

110. The masked cytokine of embodiment 108 or embodiment 109, wherein the masked cytokine is modified, or is further modified, by altering the amino acid sequence of the masked cytokine such that one or more additional serine or threonine residues is/are introduced into the amino acid sequence of the masked cytokine.

111. The masked cytokine of any one of embodiments 70-110, wherein the first linker comprises a first cleavable peptide.

112. The masked cytokine of any one of embodiments 70-111, where the first linker comprises a first N-terminal spacer domain and/or a first C-terminal spacer domain.

113. The masked cytokine of embodiment 112, wherein the first linker comprises:
a) the first N-terminal spacer domain, the first cleavable peptide, and the first C-terminal spacer domain;
b) the first N-terminal spacer domain and the first cleavable peptide;
c) the first N-terminal spacer domain and the first C-terminal spacer domain;
d) the first cleavable peptide and the first C-terminal spacer domain;
e) the first N-terminal spacer domain; or
f) the first C-terminal spacer domain.

114. The masked cytokine of any one of embodiments 111-113, wherein the first cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555.

115. The masked cytokine of any one of embodiments 112-114, wherein the first N-terminal spacer domain comprises an amino acid sequence selected from the group consisting of SEQ ID NOs: 20-95, 235, 268, 269, 303-305, 323-338, 340, 341, 727, 794, and 799.

116. The masked cytokine of any one of embodiments 112-115, wherein the first C-terminal spacer domain comprises an amino acid sequence selected from the group consisting of SEQ ID NOs: 20-95, 235, 268, 269, 303-305, 323-338, 340, 341, 727, 794, and 799.

117. The masked cytokine of any one of embodiments 111-113, wherein the first cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

118. The masked cytokine of embodiment 117, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

119. The masked cytokine of any one of embodiments 70-118, wherein the first linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812.

120. The masked cytokine of any one of embodiments 70-119, wherein the second linker comprises a second cleavable peptide.

121. The masked cytokine of any one of embodiments 70-120, wherein the second linker comprises a second N-terminal spacer domain and/or a second C-terminal spacer domain.

122. The masked cytokine of embodiment 121, wherein the second linker comprises:
a) the second N-terminal spacer domain, the second cleavable peptide, and second first C-terminal spacer domain;
b) the second N-terminal spacer domain and the second cleavable peptide;
c) the second N-terminal spacer domain and the second C-terminal spacer domain;
d) the second cleavable peptide and the second C-terminal spacer domain;
e) the second N-terminal spacer domain; or
f) the second C-terminal spacer domain.

123. The masked cytokine of any one of embodiments 120-122, wherein the second cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555.

124. The masked cytokine of any one of embodiments 121-123, wherein the second N-terminal spacer domain comprises an amino acid sequence selected from the group consisting of SEQ ID NOs: 20-95, 235, 268, 269, 303-305, 323-338, 340, 341, 727, 794, and 799.

125. The masked cytokine of any one of embodiments 121-124, wherein the second C-terminal spacer domain comprises an amino acid sequence selected from the group consisting of SEQ ID NOs: 20-95, 235, 268, 269, 303-305, 323-338, 340, 341, 727, 794, and 799.

126. The masked cytokine of any one of embodiments 120-122, wherein the second cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

127. The masked cytokine of embodiment 126, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

128. The masked cytokine of any one of embodiments 70-127, wherein the second linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812.

129. The masked cytokine of any one of embodiments 72-128, wherein the third linker comprises a third cleavable peptide.

130. The masked cytokine of any one of embodiments 72-129, wherein the third linker comprises a third N-terminal spacer domain and/or a third C-terminal spacer domain.

131. The masked cytokine of embodiment 130, wherein the third linker comprises:

a) the third N-terminal spacer domain, the third cleavable peptide, and third first C-terminal spacer domain;

b) the third N-terminal spacer domain and the third cleavable peptide;

c) the third N-terminal spacer domain and the third C-terminal spacer domain;

d) the third cleavable peptide and the third C-terminal spacer domain;

e) the third N-terminal spacer domain; or f) the third C-terminal spacer domain.

132. The masked cytokine of any one of embodiments 129-131, wherein the third cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555.

133. The masked cytokine of any one of embodiments 130-132, wherein the third N-terminal spacer domain comprises an amino acid sequence selected from the group consisting of SEQ ID NOs: 20-95, 235, 268, 269, 303-305, 323-338, 340, 341, 727, 794, and 799.

134. The masked cytokine of any one of embodiments 130-133, wherein the third C-terminal spacer domain comprises an amino acid sequence selected from the group consisting of SEQ ID NOs: 20-95, 235, 268, 269, 303-305, 323-338, 340, 341, 727, 794, and 799.

135. The masked cytokine of any one of embodiments 129-131, wherein the third cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

136. The masked cytokine of embodiment 135, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

137. The masked cytokine of any one of embodiments 72-136, wherein the third linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812.

138. The masked cytokine of any one of embodiments 52-137, wherein the first cleavable peptide, the second cleavable peptide, and/or the third cleavable peptide is a substrate for a protease that is co-localized in a region or a tissue expressing a cytokine receptor.

139. The masked cytokine of embodiment 138, wherein the cytokine receptor is an IL-2 cytokine receptor or an IL-15 cytokine receptor.

140. The masked cytokine of any one of embodiments 1-139, wherein one or more of the first cleavable peptide, the second cleavable peptide, and the third cleavable peptide is cleaved by one or more enzyme selected from the group consisting of: ABHD12, ADAM12, ABHD12B, ABHD13, ABHD17A, ADAM19, ADAM20, ADAM21, ADAM28, ADAM30, ADAM33, ADAM8, ABHD17A, ADAMDEC1, ADAMTS1, ADAMTS10, ADAMTS12, ADAMTS13, ADAMTS14, ADAMTS15, ADAMTS16, ADAMTS17, ADAMTS18, ADAMTS19, ADAMTS2, ADAMTS20, ADAMTS3, ADAMTS4, ABHD17B, ADAMTS5, ADAMTS6, ADAMTS7, ADAMTS8, ADAMTS9, ADAMTSL1, ADAMTSL2, ADAMTSL3, ABHD17C, ADAMTSL5, ASTL, BMP1, CELA1, CELA2A, CELA2B, CELA3A, CELA3B, ADAM10, ADAM15, ADAM17, ADAM9, ADAMTS4, CTSE, CTSF, ADAMTSL4, CMA1, CTRB1, CTRC, CTSO, CTR1, CTSA, CTSW, CTSB, CTSC, CTSD, ESP1, CTSG, CTSH, GZMA, GZMB, GZMH, CTSK, GZMM, CTSL, CTSS, CTSV, CTSZ, HTRA4, KLK10, KLK11, KLK13, KLK14, KLK2, KLK4, DPP4, KLK6, KLK7, KLKB1, ECE1, ECE2, ECEL1, MASP2, MEP1A, MEP1B, ELANE, FAP, GZMA, MMP11, GZMK, HGFAC, HPN, HTRA1, MMP11, MMP16, MMP17, MMP19, HTRA2, MMP20, MMP21, HTRA3, HTRA4, KEL, MMP23B, MMP24, MMP25, MMP26, MMP27, MMP28, KLK5, MMP3, MMP7, MMP8, MMP9, LGMN, LNPEP, MASP1, PAPPA, PAPPA2, PCSK1, NAPSA, PCSK5, PCSK6, MME, MMP1, MMP10, PLAT, PLAU, PLG, PRSS1, PRSS12, PRSS2, PRSS21, PRSS3, PRSS33, PRSS4, PRSS55, PRSS57, MMP12, PRSS8, PRSS9, PRTN3, MMP13, MMP14, ST14, TMPRSS10, TMPRSS11A, TMPRSS11D, TMPRSS11E, TMPRSS11F, TMPRSS12, TMPRSS13, MMP15, TMPRSS15, MMP2, TMPRSS2, TMPRSS3, TMPRSS4, TMPRSS5, TMPRSS6, TMPRSS7, TMPRSS9, NRDC, OVCH1, PAMR1, PCSK3, PHEX, TINAG, TPSAB1, TPSD1, and TPSG1.

141. The masked cytokine of any one of embodiments 2-69 and 71-140, wherein the half-life extension domain is conjugated to an agent.

142. The masked cytokine of embodiment 141, wherein the agent is an inhibitor of tubulin polymerization, a DNA damaging agent, or a DNA synthesis inhibitor.

143. The masked cytokine of embodiment 142, wherein the agent is a maytansinoid, an auristatin, a pyrrolobenzodiazepine (PBD) dimer, a calicheamicin, a duocarmycin, a indo-linobenzodiazepine dimer or exatecan derivative Dxd.

144. The masked cytokine of embodiment 141, wherein the agent is an immune stimulant.

145. The masked cytokine of embodiment 144, wherein the immune stimulant is a stimulator of interferon genes (STING) agonist or a toll-like receptor (TLR) agonist.

146. The masked cytokine of embodiment 145, wherein the STING agonist is a cyclic dinucleotide (CDN).

147. The masked cytokine of embodiment 146, wherein the CDN is selected from the group consisting of cGAMP, c-di-AMP, c-di-GMP, cAIMP, c-di-IMP, 4-(2-chloro-6-fluorobenzyl)-N-(furan-2-ylmethyl)-3-oxo-3,4-dihydro-2H-benzo[b][1,4]thiazine-6-carboxamide.

148. The masked cytokine of embodiment 145, wherein the TLR agonist is an agonist of a TLR selected from the group consisting of TLR1, TLR2, TLR3, TLR4, TLR5, TLR6, TLR7, TLR8, TLR9, and TLR10.

149. A masked cytokine comprising:

a) a first half-life extension domain and a second half-life extension domain;

b) a masking moiety; and c) a cytokine or functional fragment thereof, wherein the masking moiety is linked to the first half-life extension domain, wherein the cytokine or functional fragment thereof is linked to the second half-life extension domain, and wherein the first half-life extension domain and the second half-life extension domain contain modifications promoting the association of the first and the second half-life extension domain.

150. The masked cytokine of embodiment 149, wherein the masking moiety is linked to the first half-life extension domain via a first linker; and/or wherein the cytokine or functional fragment thereof is linked to the second half-life extension domain via a second linker.

151. The masked cytokine of embodiment 149 or embodiment 150, wherein the cytokine or functional fragment thereof is an IL-2 polypeptide or functional fragment thereof.

152. The masked cytokine of embodiment 151, wherein the IL-2 polypeptide or functional fragment thereof comprises an amino acid sequence selected from the group consisting of SEQ ID NOs: 1-8, 160, 230, 243-251, 260, 775-792, and 813-822.

153. The masked cytokine of embodiment 151, wherein the IL-2 polypeptide or functional fragment thereof comprises an amino acid sequence produced by introducing one or more amino acid substitutions into the amino acid sequence of the IL-2 polypeptide or functional fragment thereof that reduces the affinity of the IL-2 polypeptide or functional fragment thereof for CD25 (IL-2Rα).

154. The masked cytokine of embodiment 153, wherein the amino acid sequence is produced by introducing one or more of the following amino acid substitutions into any one of SEQ ID NOs: 1-8, 160, 243-251, 260, 775-792, and 813-822: R38A, F42A, F42K, F42E, K43A, Y45A, Y45N, Y45R, E62A, E62R, E62S, and L72G.

155. The masked cytokine of embodiment 151, wherein the IL-2 polypeptide or functional fragment thereof comprises an amino acid sequence produced by introducing one or more amino acid substitutions into the amino acid sequence of the IL-2 polypeptide or functional fragment thereof that increases the affinity of the IL-2 polypeptide or functional fragment thereof for IL-2Rβ or IL-2Rγ.

156. The masked cytokine of embodiment 155, wherein the amino acid sequence is produced by introducing one or more of the following amino acid substitutions into any one of SEQ ID NOs: 1-8, 160, 243-251, 260, 775-792, and 813-822: H16I, L18C, D20A, D20L, D20F, N29L, L80F, R81D, L85V, I86V, and I92F.

157. The masked cytokine of embodiment 153 or embodiment 154, wherein the amino acid sequence is produced by further introducing one or more amino acid substitutions that increase the affinity of the IL-2 polypeptide or functional fragment thereof for IL-2Rβ or IL-2Rγ.

158. The masked cytokine of embodiment 157, wherein the one or more amino acid substitutions that increase the affinity of the IL-2 polypeptide or functional fragment thereof for IL-2Rβ or IL-2Rγ is selected from the group consisting of H16I, L18C, D20A, D20L, D20F, N29L, L80F, R81D, L85V, I86V, and I92F.

159. The masked cytokine of embodiment 151, wherein the IL-2 polypeptide or functional fragment thereof comprises an amino acid sequence produced by introducing one or more amino acid substitutions into the amino acid sequence of the IL-2 polypeptide or functional fragment thereof that stabilizes the IL-2 polypeptide or functional fragment thereof.

160. The masked cytokine of embodiment 159, wherein the amino acid sequence is produced by introducing one of the following amino acid substitutions into any one of SEQ ID NOs: 1-8, 160, 243-251, 260, 775-792, and 813-822: C125S, C125A, and C125G.

161. The masked cytokine of any one of embodiments 153-158, wherein the amino acid sequence is produced by further introducing one or more amino acid substitutions that stabilize the IL-2 polypeptide or functional fragment thereof.

162. The masked cytokine of embodiment 161, wherein the one or more amino acid substitutions that stabilize the IL-2 polypeptide or functional fragment thereof is the amino acid substitution C125S, C125A, or C125G.

163. The masked cytokine of any one of embodiments 151-162, wherein the masking moiety comprises an amino acid sequence selected from the group consisting of SEQ ID NOs: 9, 10, 161-165, 187-218, 221-229, 231, 261, 826 and 827.

164. The masked cytokine of embodiment 149 or embodiment 150, wherein the cytokine or functional fragment thereof is an IL-15 polypeptide or functional fragment thereof.

165. The masked cytokine of embodiment 164, wherein the IL-15 polypeptide or functional fragment thereof comprises the amino acid sequence of SEQ ID NO: 167.

166. The masked cytokine of embodiment 164 or embodiment 165, wherein the masking moiety comprises an amino acid sequence selected from the group consisting of SEQ ID NOs: 10, 161-165, 219-229, 232-234, 261, and 823-827.

167. The masked cytokine of embodiment 164 or embodiment 165, wherein the masking moiety comprises an amino acid sequence produced by introducing one or more of the following amino acid substitutions into the amino acid sequence of any one of SEQ ID NOs: 232-234, and 823-825: R24A, R26A, K34A, S40A, L42A, and P67A.

168. The masked cytokine of any one of embodiment 149-167, wherein the first half-life extension domain is a first antibody or fragment thereof, and the second half-life extension domain is a second antibody or fragment thereof.

169. The masked cytokine of embodiment 168, wherein:

a) the first antibody or fragment thereof comprises a first heavy chain polypeptide, and the second antibody or fragment thereof comprises a second light chain polypeptide; or b) the first antibody or fragment thereof comprises a first light chain polypeptide, and the second antibody or fragment thereof comprises a second heavy chain polypeptide.

170. The masked cytokine of embodiment 169, wherein the first heavy chain polypeptide or the second heavy chain polypeptide comprises one or more amino acid substitutions altering effector function.

171. The masked cytokine of embodiment 170, wherein the first heavy chain polypeptide or the second heavy chain polypeptide:
   a) is an IgG1 isotype and comprises the amino substitution(s):
      i) N297A, N297G, or N297Q;
      ii) L234A and L235A;
      iii) C220S, C226S, C229S, and P238S;
      iv) C226S, C229S, E233P, L234V, and L235A;
      v) L234F, L235E, and P331S;
      vi) S267E and L328F;
      vii) D265A;
      viii) L234A, L235A, and P329G;
   b) is an IgG2 isotype and comprises the amino acid substitution(s):
      i) V234A and G237A;
      ii) H268Q, V309L, A330S, and A331S; or
      iii) V234A, G237A, P238S, H268A, V309L, A330S, and P331S; or
   e) is an IgG4 isotype and comprises the amino acid substitution(s):
      i) L235A, G237A, and E318A;
      ii) S228P, L234A, and L235A;
      iii) H268Q, V309L, A330S, and P331S; or
      iv) S228P and L235A, numbered according to the Kabat EU numbering system.

172. The masked cytokine of embodiment 170, wherein the first heavy chain polypeptide or the second heavy chain polypeptide comprises one or more amino acid substitutions enhancing effector function.

173. The masked cytokine of embodiment 172, wherein the first heavy chain polypeptide or the second heavy chain polypeptide is an IgG1 heavy chain polypeptide and comprises the amino acid substitution(s):
   a) S298A, E333A, and K334A;
   b) S239D and I332E;
   c) S239D, A330L, and I332E;
   d) P247I and A339D or A339Q;
   e) D280H and K290S;
   f) D280H, K290S, and either S298D or S298V;
   g) F243L, R292P, and Y300L;
   h) F243L, R292P, Y300L, and P396L;
   i) F243L, R292P, Y300L, V305I, and P396L;
   j) G236A, S239D, and I332E;
   k) K326A and E333A;
   l) K326W and E333S;
   m) K290E, S298G, and T299A;
   n) K290E, S298G, T299A, and K326E;
   o) K290N, S298G, and T299A;
   p) K290N, S298G, T299A, and K326E;
   q) K334V;
   r) L235S, S239D, and K334V;
   s) K334V and Q331M, S239D, F243V, E294L, or S298T;
   t) E233L, Q311M, and K334V;
   u) L234I, Q311M, and K334V;
   v) K334V and S298T, A330M, or A330F;
   w) K334V, Q311M, and either A330M or A330F;
   x) K334V, S298T, and either A330M or A330F;
   y) K334V, S239D, and either A330M or S298T;
   z) L234Y, Y296W, and K290Y, F243V, or E294L;
   aa) Y296W and either L234Y or K290Y;
   ab) S239D, A330S, and I332E,
   ac) V264I;
   ad) F243L and V264I;
   ae) L328M;
   af) I332E;
   ag) L328M and I332E;
   ah) V264I and I332E;
   ai) S239E and I332E;
   aj) S239Q and I332E;
   ak) S239E;
   al) A330Y;
   am) I332D;
   an) L328I and I332E;
   ao) L328Q and I332E;
   ap) V264T;
   aq) V240I;
   ar) V266I;
   as) S239D;
   at) S239D and I332D;
   au) S239D and I332N;
   av) S239D and I332Q;
   aw) S239E and I332D;
   ax) S239E and I332N;
   ay) S239E and I332Q;
   az) S239N and I332D;
   ba) S239N and I332E;
   bb) S239Q and I332D;
   bc) A330Y and I332E;
   bd) V264I, A330Y, and I332E;
   be) A330L and I332E;
   bf) V264I, A330L, and I332E;
   bg) L234E, L234Y, or L234I;
   bh) L235D, L235S, L235Y, or L235I;
   bi) S239T;
   bj) V240M;
   bk) V264Y;
   bl) A330I;
   bm) N325T;
   bn) I332E and L328D, L328V, L328T, or L328I;
   bo) V264I, I332E, and either S239E or S239Q;
   bp) S239E, V264I, A330Y, and I332E;
   bq) A330Y, I332E, and either S239D or S239N;
   br) A330L, I332E, and either S239D or S239N;
   bs) V264I, S298A, and I332E;
   bt) S298A, I332E, and either S239D or S239N;
   bu) S239D, V264I, and I332E;
   bv) S239D, V264I, S298A, and I332E;
   bw) S239D, V264I, A330L, and I332E;
   bx) S239D, I332E, and A330I;
   by) P230A;
   bz) P230A, E233D, and I332E;
   ca) E272Y;
   cb) K274T, K274E, K274R, K274L, or K274Y;
   cd) F275W;
   ce) N276L;
   cf) Y278T;
   cg) V302I;
   ch) E318R;
   ci) S324D, S324I or S324V;
   cj) K326I or K326T;
   ck) T335D, T335R, or T335Y;
   cl) V240I and V266I;
   cm) S239D, A330Y, I332E, and L234I;
   cn) S239D, A330Y, I332E, and L235D;
   co) S239D, A330Y, I332E, and V240I;
   cp) S239D, A330Y, I332E, and V264T; or
   cq) S239D, A330Y, I332E, and either K326E or K326T, numbered according to the Kabat EU numbering system.

174. The masked cytokine of embodiment 169, wherein the first heavy chain polypeptide comprises an amino acid sequence selected from the group consisting of SEQ ID NOs: 158, 168, and 169, and the second heavy chain polypeptide comprises an amino acid sequence selected from the group consisting of SEQ ID NOs: 158, 168, and 169.

175. The masked cytokine of embodiment 169, wherein the first light chain polypeptide comprises the amino acid sequence of SEQ ID NO: 157 or 170, and the second light chain polypeptide comprises the amino acid sequence of SEQ ID NO: 157 or 170.

176. The masked cytokine of embodiment 168, wherein the first antibody or fragment thereof is a first Fragment crystallizable domain (Fc domain) or fragment thereof, and the second antibody or fragment thereof is a second Fc domain or fragment thereof.

177. The masked cytokine of embodiment 176, wherein the first Fc domain or fragment thereof, and/or the second Fc domain or fragment thereof comprises one or more amino acid substitutions altering effector function.

178. The masked cytokine of embodiment 177, wherein the first Fc domain or fragment thereof and/or the second Fc domain or fragment thereof:
 a) is an IgG1 Fc domain or fragment thereof and comprises the amino substitution(s):
  i) N297A, N297G, or N297Q;
  ii) L234A and L235A;
  iii) C220S, C226S, C229S, and P238S;
  iv) C226S, C229S, E233P, L234V, and L235A;
  v) L234F, L235E, and P331S;
  vi) S267E and L328F;
  vii) D265A;
  viii) L234A, L235A, and P329G;
 b) is an IgG2 Fc domain or fragment thereof and comprises the amino acid substitution(s):
  i) V234A and G237A;
  ii) H268Q, V309L, A330S, and A331S; or
  iii) V234A, G237A, P238S, H268A, V309L, A330S, and P331S; or
 e) is an IgG4 Fc domain or fragment thereof and comprises the amino acid substitution(s):
  i) L235A, G237A, and E318A;
  ii) S228P, L234A, and L235A;
  iii) H268Q, V309L, A330S, and P331S; or
  iv) S228P and L235A, numbered according to the Kabat EU numbering system.

179. The masked cytokine of embodiment 177, wherein the first Fc domain or fragment thereof, and/or the second Fc domain or fragment thereof comprises one or more amino acid substitutions enhancing effector function.

180. The masked cytokine of embodiment 179, wherein the first Fc domain or fragment thereof and/or the second Fc domain or fragment thereof is an IgG1 Fc domain or fragment thereof and comprises the amino acid substitution(s):
 a) S298A, E333A, and K334A;
 b) S239D and I332E;
 c) S239D, A330L, and I332E;
 d) P247I and A339D or A339Q;
 e) D280H and K290S;
 f) D280H, K290S, and either S298D or S298V;
 g) F243L, R292P, and Y300L;
 h) F243L, R292P, Y300L, and P396L;
 i) F243L, R292P, Y300L, V305I, and P396L;
 j) G236A, S239D, and I332E;
 k) K326A and E333A;
 l) K326W and E333S;
 m) K290E, S298G, and T299A;
 n) K290E, S298G, T299A, and K326E;
 o) K290N, S298G, and T299A;
 p) K290N, S298G, T299A, and K326E;
 q) K334V;
 r) L235S, S239D, and K334V;
 s) K334V and Q331M, S239D, F243V, E294L, or S298T;
 t) E233L, Q311M, and K334V;
 u) L234I, Q311M, and K334V;
 v) K334V and S298T, A330M, or A330F;
 w) K334V, Q311M, and either A330M or A330F;
 x) K334V, S298T, and either A330M or A330F;
 y) K334V, S239D, and either A330M or S298T;
 z) L234Y, Y296W, and K290Y, F243V, or E294L;
 aa) Y296W and either L234Y or K290Y;
 ab) S239D, A330S, and I332E,
 ac) V264I;
 ad) F243L and V264I;
 ae) L328M;
 af) I332E;
 ag) L328M and I332E;
 ah) V264I and I332E;
 ai) S239E and I332E;
 aj) S239Q and I332E;
 ak) S239E;
 al) A330Y;
 am) I332D;
 an) L328I and I332E;
 ao) L328Q and I332E;
 ap) V264T;
 aq) V240I;
 ar) V266I;
 as) S239D;
 at) S239D and I332D;
 au) S239D and I332N;
 av) S239D and I332Q;
 aw) S239E and I332D;
 ax) S239E and I332N;
 ay) S239E and I332Q;
 az) S239N and I332D;
 ba) S239N and I332E;
 bb) S239Q and I332D;
 bc) A330Y and I332E;
 bd) V264I, A330Y, and I332E;
 be) A330L and I332E;
 bf) V264I, A330L, and I332E;
 bg) L234E, L234Y, or L234I;
 bh) L235D, L235S, L235Y, or L235I;
 bi) S239T;
 bj) V240M;
 bk) V264Y;
 bl) A330I;
 bm) N325T;
 bn) I332E and L328D, L328V, L328T, or L328I;
 bo) V264I, I332E, and either S239E or S239Q;
 bp) S239E, V264I, A330Y, and I332E;
 bq) A330Y, I332E, and either S239D or S239N;
 br) A330L, I332E, and either S239D or S239N;
 bs) V264I, S298A, and I332E;
 bt) S298A, I332E, and either S239D or S239N;
 bu) S239D, V264I, and I332E;
 by) S239D, V264I, S298A, and I332E;
 bw) S239D, V264I, A330L, and I332E;
 bx) S239D, I332E, and A330I;
 by) P230A;
 bz) P230A, E233D, and I332E;

ca) E272Y;
cb) K274T, K274E, K274R, K274L, or K274Y;
cd) F275W;
ce) N276L;
cf) Y278T;
cg) V302I;
ch) E318R;
ci) S324D, S324I or S324V;
cj) K326I or K326T;
ck) T335D, T335R, or T335Y;
cl) V240I and V266I;
cm) S239D, A330Y, I332E, and L234I;
cn) S239D, A330Y, I332E, and L235D;
co) S239D, A330Y, I332E, and V240I;
cp) S239D, A330Y, I332E, and V264T; or
cq) S239D, A330Y, I332E, and either K326E or K326T,
numbered according to the Kabat EU numbering system.

181. The masked cytokine of embodiment 176, wherein:
a) the first Fc domain or fragment thereof comprises the amino acid sequence of SEQ ID NO: 155, and the second Fc domain or fragment thereof comprises the amino acid sequence of SEQ ID NO: 156;
b) the first Fc domain or fragment thereof comprises the amino acid sequence of SEQ ID NO: 156, and the second Fc domain or fragment thereof comprises the amino acid sequence of SEQ ID NO: 155;
c) the first Fc domain or fragment thereof comprises the amino acid sequence of SEQ ID NO: 154, and the second Fc domain or fragment thereof comprises the amino acid sequence of SEQ ID NO: 154;
d) the first Fc domain or fragment thereof comprises the amino acid sequence of SEQ ID NO: 265, and the second Fc domain or fragment thereof comprises the amino acid sequence of SEQ ID NO: 156;
e) the first Fc domain or fragment thereof comprises the amino acid sequence of SEQ ID NO: 156, and the second Fc domain or fragment thereof comprises the amino acid sequence of SEQ ID NO: 265;
f) the first Fc domain or fragment thereof comprises the amino acid sequence of SEQ ID NO: 155, and the second Fc domain or fragment thereof comprises the amino acid sequence of SEQ ID NO: 616;
g) the first Fc domain or fragment thereof comprises the amino acid sequence of SEQ ID NO: 616, and the second Fc domain or fragment thereof comprises the amino acid sequence of SEQ ID NO: 155;
h) the first Fc domain or fragment thereof comprises the amino acid sequence of SEQ ID NO: 157, and the second Fc domain or fragment thereof comprises the amino acid sequence of SEQ ID NO: 158;
i) the first Fc domain or fragment thereof comprises the amino acid sequence of SEQ ID NO: 158, and the second Fc domain or fragment thereof comprises the amino acid sequence of SEQ ID NO: 157;
j) the first Fc domain or fragment thereof comprises the amino acid sequence of SEQ ID NO: 796, and the second Fc domain or fragment thereof comprises the amino acid sequence of SEQ ID NO: 774;
k) the first Fc domain or fragment thereof comprises the amino acid sequence of SEQ ID NO: 774, and the second Fc domain or fragment thereof comprises the amino acid sequence of SEQ ID NO: 796;
l) the first Fc domain or fragment thereof comprises the amino acid sequence of SEQ ID NO: 721, and the second Fc domain or fragment thereof comprises the amino acid sequence of SEQ ID NO: 619;
m) the first Fc domain or fragment thereof comprises the amino acid sequence of SEQ ID NO: 619, and the second Fc domain or fragment thereof comprises the amino acid sequence of SEQ ID NO: 721;
n) the first Fc domain or fragment thereof comprises the amino acid sequence of SEQ ID NO: 721, and the second Fc domain or fragment thereof comprises the amino acid sequence of SEQ ID NO: 772;
o) the first Fc domain or fragment thereof comprises the amino acid sequence of SEQ ID NO: 772, and the second Fc domain or fragment thereof comprises the amino acid sequence of SEQ ID NO: 721;
p) the first Fc domain or fragment thereof comprises the amino acid sequence of SEQ ID NO: 793, and the second Fc domain or fragment thereof comprises the amino acid sequence of SEQ ID NO: 622;
q) the first Fc domain or fragment thereof comprises the amino acid sequence of SEQ ID NO: 622, and the second Fc domain or fragment thereof comprises the amino acid sequence of SEQ ID NO: 793;
r) the first Fc domain or fragment thereof comprises the amino acid sequence of SEQ ID NO: 793, and the second Fc domain or fragment thereof comprises the amino acid sequence of SEQ ID NO: 773;
s) the first Fc domain or fragment thereof comprises the amino acid sequence of SEQ ID NO: 773, and the second Fc domain or fragment thereof comprises the amino acid sequence of SEQ ID NO: 793;
t) the first Fc domain or fragment thereof comprises the amino acid sequence of SEQ ID NO: 796, and the second Fc domain or fragment thereof comprises the amino acid sequence of SEQ ID NO: 625;
u) the first Fc domain or fragment thereof comprises the amino acid sequence of SEQ ID NO: 625, and the second Fc domain or fragment thereof comprises the amino acid sequence of SEQ ID NO: 796;
v) the first Fc domain or fragment thereof comprises the amino acid sequence of SEQ ID NO: 156, and the second Fc domain or fragment thereof comprises the amino acid sequence of SEQ ID NO: 156;
w) the first Fc domain or fragment thereof comprises the amino acid sequence of SEQ ID NO: 796, and the second Fc domain or fragment thereof comprises the amino acid sequence of SEQ ID NO: 625; or
x) the first Fc domain or fragment thereof comprises the amino acid sequence of SEQ ID NO: 625, and the second Fc domain or fragment thereof comprises the amino acid sequence of SEQ ID NO: 796.

182. The masked cytokine of any one of embodiments 149-167, wherein the first half-life extension domain is a first scFv or fragment thereof, and the second half-life extension domain is a second scFv or fragment thereof.

183. The masked cytokine of any one of embodiments 149-167, wherein the first half-life extension domain is a first Fc domain or fragment thereof, and the second half-life extension domain is a second Fc domain or fragment thereof, and wherein the first Fc domain or fragment thereof is linked to the second Fc domain or fragment thereof.

184. The masked cytokine of embodiment 183, wherein the first Fc domain or fragment thereof is linked to the second Fc domain or fragment thereof via a third linker.

185. The masked cytokine of any one of embodiments 149-167, wherein:
a) the first half-life extension domain is an scFv or fragment thereof, and the second half-life extension domain is an antibody or fragment thereof; or b) the first half-life extension domain is an antibody or fragment thereof, and the second half-life extension domain is an scFv or fragment thereof.

186. The masked cytokine of any one of embodiments 168-181, wherein the modifications promoting the association of the first and the second half-life extension domain comprise:

a) introducing S354C and T366W mutations in the first antibody or fragment thereof, and introducing Y349C, T366S, L368A, and Y407V mutations in the second antibody or fragment thereof, numbered according to the Kabat EU numbering system;

b) introducing S354C and T366W mutations in the second antibody or fragment thereof, and introducing Y349C, T366S, L368A, and Y407V mutations in the first antibody or fragment thereof, numbered according to the Kabat EU numbering system;

c) introducing K392D and K409D mutations in the first antibody or fragment thereof, and introducing D399K and E356K mutations in the second antibody or fragment thereof, numbered according to the Kabat EU numbering system;

d) introducing K392D and K409D mutations in the second antibody or fragment thereof, and introducing D399K and E356K mutations in the first antibody or fragment thereof, numbered according to the Kabat EU numbering system;

e) introducing S364H and F405A mutations in the first antibody or fragment thereof, and introducing Y349T and T394F mutations in the second antibody or fragment thereof, numbered according to the Kabat EU numbering system; or f) introducing S364H and F405A mutations in the second antibody or fragment thereof, and introducing Y349T and T394F mutations in the first antibody or fragment thereof, numbered according to the Kabat EU numbering system.

187. The masked cytokine of any one of embodiments 168-181, wherein the amino acid sequence of the first antibody or fragment thereof and the amino acid sequence of the second antibody or fragment thereof are produced by:

a) introducing S354C and T366W mutations in the amino acid sequence of SEQ ID NO: 154 or 169, and introducing Y349C, T366S, L368A, and Y407V mutations in the amino acid sequence of SEQ ID NO: 154 or 169, respectively, numbered according to the Kabat EU numbering system;

b) introducing S354C and T366W mutations in the amino acid sequence of SEQ ID NO: 154 or 169, and introducing Y349C, T366S, L368A, and Y407V mutations in the amino acid sequence of SEQ ID NO: 154 or 169, respectively, numbered according to the Kabat EU numbering system;

c) introducing K392D and K409D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

d) introducing K392D and K409D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

e) introducing S364H and F405A mutations in the amino acid sequence of SEQ ID NO: 154 or 169, and introducing Y349T and T394F mutations in the amino acid sequence of SEQ ID NO: 154 or 169, respectively, numbered according to the Kabat EU numbering system; or f) introducing S364H and F405A mutations in the amino acid sequence of SEQ ID NO: 154 or 169, and introducing Y349T and T394F mutations in the amino acid sequence of SEQ ID NO: 154 or 169, respectively, numbered according to the Kabat EU numbering system.

188. The masked cytokine of any one of embodiments 168-181, wherein the modifications promoting the association of the first and the second half-life extension domain comprise:

a) introducing a Y407T mutation in the first antibody or fragment thereof, and introducing a T366Y mutation in the second antibody or fragment thereof, numbered according to the Kabat EU numbering system;

b) introducing a Y407A mutation in the first antibody or fragment thereof, and introducing a T366W mutation in the second antibody or fragment thereof, numbered according to the Kabat EU numbering system;

c) introducing a F405A mutation in the first antibody or fragment thereof, and introducing a T394W mutation in the second antibody or fragment thereof, numbered according to the Kabat EU numbering system;

d) introducing a F405W mutation in the first antibody or fragment thereof, and introducing a T394S mutation in the second antibody or fragment thereof, numbered according to the Kabat EU numbering system;

e) introducing a Y407T mutation in the first antibody or fragment thereof, and introducing a T366Y mutation in the second antibody or fragment thereof, numbered according to the Kabat EU numbering system;

f) introducing T366Y and F405A mutations in the first antibody or fragment thereof, and introducing T394W and Y407T mutations in the second antibody or fragment thereof, numbered according to the Kabat EU numbering system;

g) introducing T366W and F405W mutations in the first antibody or fragment thereof, and introducing T394S and Y407A mutations in the second antibody or fragment thereof, numbered according to the Kabat EU numbering system;

h) introducing F405W and Y407A mutations in the first antibody or fragment thereof, and introducing T366W and T394S mutations in the second antibody or fragment thereof, numbered according to the Kabat EU numbering system;

i) introducing a T366W mutation in the first antibody or fragment thereof, and introducing T366S, L368A, and Y407V mutations in the second antibody or fragment thereof, numbered according to the Kabat EU numbering system;

j) introducing a Y407T mutation in the second antibody or fragment thereof, and introducing a T366Y mutation in the first antibody or fragment thereof, numbered according to the Kabat EU numbering system;

k) introducing a Y407A mutation in the second antibody or fragment thereof, and introducing a T366W mutation in the first antibody or fragment thereof, numbered according to the Kabat EU numbering system;

l) introducing a F405A mutation in the second antibody or fragment thereof, and introducing a T394W mutation in the first antibody or fragment thereof, numbered according to the Kabat EU numbering system;

m) introducing a F405W mutation in the second antibody or fragment thereof, and introducing a T394S mutation in the first antibody or fragment thereof, numbered according to the Kabat EU numbering system;

n) introducing a Y407T mutation in the second antibody or fragment thereof, and introducing a T366Y mutation in the first antibody or fragment thereof, numbered according to the Kabat EU numbering system;

o) introducing T366Y and F405A mutations in the second antibody or fragment thereof, and introducing T394W and Y407T mutations in the first antibody or fragment thereof, numbered according to the Kabat EU numbering system;

p) introducing T366W and F405W mutations in the second antibody or fragment thereof, and introducing T394S and Y407A mutations in the first antibody or fragment thereof, numbered according to the Kabat EU numbering system;

q) introducing F405W and Y407A mutations in the second antibody or fragment thereof, and introducing T366W and T394S mutations in the first antibody or fragment thereof, numbered according to the Kabat EU numbering system; or r) introducing a T366W mutation in the second antibody or fragment thereof, and introducing T366S, L368A, and Y407V mutations in the first antibody or fragment thereof, numbered according to the Kabat EU numbering system.

189. The masked cytokine of any one of embodiments 168-181, wherein the amino acid sequence of the first antibody or fragment thereof and the amino acid sequence of the second antibody or fragment thereof are produced by:

a) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

b) introducing a Y407A mutation in the amino acid sequence of SEQ ID NO: 154 or 169, and introducing a T366W mutation in the amino acid sequence of SEQ ID NO: 154 or 169, respectively, numbered according to the Kabat EU numbering system;

c) introducing a F405A mutation in the amino acid sequence of SEQ ID NO: 154 or 169, and introducing a T394W mutation in the amino acid sequence of SEQ ID NO: 154 or 169, respectively, numbered according to the Kabat EU numbering system;

d) introducing a F405W mutation in the amino acid sequence of SEQ ID NO: 154 or 169, and introducing a T394S mutation in the amino acid sequence of SEQ ID NO: 154 or 169, respectively, numbered according to the Kabat EU numbering system;

e) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

f) introducing T366Y and F405A mutations in the amino acid sequence of SEQ ID NO: 154 or 169, and introducing T394W and Y407T mutations in the amino acid sequence of SEQ ID NO: 154 or 169, respectively, numbered according to the Kabat EU numbering system;

g) introducing T366W and F405W mutations in the amino acid sequence of SEQ ID NO: 154 or 169, and introducing T394S and Y407A mutations in the amino acid sequence of SEQ ID NO: 154 or 169, respectively, numbered according to the Kabat EU numbering system;

h) introducing F405W and Y407A mutations in the amino acid sequence of SEQ ID NO: 154 or 169, and introducing T366W and T394S mutations in the amino acid sequence of SEQ ID NO: 154 or 169, respectively, numbered according to the Kabat EU numbering system;

i) introducing a T366W mutation in the amino acid sequence of SEQ ID NO: 154 or 169, and introducing T366S, L368A, and Y407V mutations in the amino acid sequence of SEQ ID NO: 154 or 169, respectively, numbered according to the Kabat EU numbering system;

j) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

k) introducing a Y407A mutation in the amino acid sequence of SEQ ID NO: 154 or 169, and introducing a T366W mutation in the amino acid sequence of SEQ ID NO: 154 or 169, respectively, numbered according to the Kabat EU numbering system;

l) introducing a F405A mutation in the amino acid sequence of SEQ ID NO: 154 or 169, and introducing a T394W mutation in the amino acid sequence of SEQ ID NO: 154 or 169, respectively, numbered according to the Kabat EU numbering system;

m) introducing a F405W mutation in the amino acid sequence of SEQ ID NO: 154 or 169, and introducing a T394S mutation in the amino acid sequence of SEQ ID NO: 154 or 169, respectively, numbered according to the Kabat EU numbering system;

n) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

o) introducing T366Y and F405A mutations in the amino acid sequence of SEQ ID NO: 154 or 169, and introducing T394W and Y407T mutations in the amino acid sequence of SEQ ID NO: 154 or 169, respectively, numbered according to the Kabat EU numbering system;

p) introducing T366W and F405W mutations in the amino acid sequence of SEQ ID NO: 154 or 169, and introducing T394S and Y407A mutations in the amino acid sequence of SEQ ID NO: 154 or 169, respectively, numbered according to the Kabat EU numbering system;

q) introducing F405W and Y407A mutations in the amino acid sequence of SEQ ID NO: 154 or 169, and introducing T366W and T394S mutations in the amino acid sequence of SEQ ID NO: 154 or 169, respectively, numbered according to the Kabat EU numbering system; or r) introducing a T366W mutation in the amino acid sequence of SEQ ID NO: 154 or 169, and introducing T366S, L368A, and Y407V mutations in the amino acid sequence of SEQ ID NO: 154 or 169, respectively, numbered according to the Kabat EU numbering system.

190. The masked cytokine of any one of embodiments 168-181, wherein the modifications promoting the association of the first and the second half-life extension domain comprise:

a) introducing a K409E mutation in the first antibody or fragment thereof, and introducing a D399K mutation in the second antibody or fragment thereof, numbered according to the Kabat EU numbering system;

b) introducing a K409E mutation in the first antibody or fragment thereof, and introducing a D399R mutation in the second antibody or fragment thereof, numbered according to the Kabat EU numbering system;

c) introducing a K409D mutation in the first antibody or fragment thereof, and introducing a D399K mutation in the second antibody or fragment thereof, numbered according to the Kabat EU numbering system;

d) introducing a K409D mutation in the first antibody or fragment thereof, and introducing a D399R mutation in the second antibody or fragment thereof, numbered according to the Kabat EU numbering system;

e) introducing a K392E mutation in the first antibody or fragment thereof, and introducing a D399R mutation in the second antibody or fragment thereof, numbered according to the Kabat EU numbering system;

f) introducing a K392E mutation in the first antibody or fragment thereof, and introducing a D399K mutation in the second antibody or fragment thereof, numbered according to the Kabat EU numbering system;

g) introducing a K392D mutation in the first antibody or fragment thereof, and introducing a D399R mutation in the second antibody or fragment thereof, numbered according to the Kabat EU numbering system;

h) introducing a K392D mutation in the first antibody or fragment thereof, and introducing a D399K mutation in the second antibody or fragment thereof, numbered according to the Kabat EU numbering system;

i) introducing K409D and K360D mutations in the first antibody or fragment thereof, and introducing D399K and E356K mutations in the second antibody or fragment thereof, numbered according to the Kabat EU numbering system;

j) introducing K409D and K370D mutations in the first antibody or fragment thereof, and introducing D399K and E357K mutations in the second antibody or fragment thereof, numbered according to the Kabat EU numbering system;

k) introducing K409D and K392D mutations in the first antibody or fragment thereof, and introducing D399K, E356K, and E357K mutations in the second antibody or fragment thereof, numbered according to the Kabat EU numbering system;

l) introducing K409D and K392D mutations in the first antibody or fragment thereof, and introducing a D399K mutation in the second antibody or fragment thereof, numbered according to the Kabat EU numbering system;

m) introducing K409D and K392D mutations in the first antibody or fragment thereof, and introducing D399K and E356K mutations in the second antibody or fragment thereof, numbered according to the Kabat EU numbering system;

n) introducing K409D and K392D mutations in the first antibody or fragment thereof, and introducing D399K and E357K mutations in the second antibody or fragment thereof, numbered according to the Kabat EU numbering system;

o) introducing K409D and K370D mutations in the first antibody or fragment thereof, and introducing D399K and E357K mutations in the second antibody or fragment thereof, numbered according to the Kabat EU numbering system;

p) introducing a D399K mutation in the first antibody or fragment thereof, and introducing K409D and K360D mutations in the second antibody or fragment thereof, numbered according to the Kabat EU numbering system;

q) introducing K409D and K439D mutations in the first antibody or fragment thereof, and introducing D399K and E356K mutations in the second antibody or fragment thereof, numbered according to the Kabat EU numbering system;

r) introducing a K409E mutation in the second antibody or fragment thereof, and introducing a D399K mutation in the first antibody or fragment thereof, numbered according to the Kabat EU numbering system;

s) introducing a K409E mutation in the second antibody or fragment thereof, and introducing a D399R mutation in the first antibody or fragment thereof, numbered according to the Kabat EU numbering system;

t) introducing a K409D mutation in the second antibody or fragment thereof, and introducing a D399K mutation in the first antibody or fragment thereof, numbered according to the Kabat EU numbering system;

u) introducing a K409D mutation in the second antibody or fragment thereof, and introducing a D399R mutation in the first antibody or fragment thereof, numbered according to the Kabat EU numbering system;

v) introducing a K392E mutation in the second antibody or fragment thereof, and introducing a D399R mutation in the first antibody or fragment thereof, numbered according to the Kabat EU numbering system;

w) introducing a K392E mutation in the second antibody or fragment thereof, and introducing a D399K mutation in the first antibody or fragment thereof, numbered according to the Kabat EU numbering system;

x) introducing a K392D mutation in the second antibody or fragment thereof, and introducing a D399R mutation in the first antibody or fragment thereof, numbered according to the Kabat EU numbering system;

y) introducing a K392D mutation in the second antibody or fragment thereof, and introducing a D399K mutation in the first antibody or fragment thereof, numbered according to the Kabat EU numbering system;

z) introducing K409D and K360D mutations in the second antibody or fragment thereof, and introducing D399K and E356K mutations in the first antibody or fragment thereof, numbered according to the Kabat EU numbering system;

aa) introducing K409D and K370D mutations in the second antibody or fragment thereof, and introducing D399K and E357K mutations in the first antibody or fragment thereof, numbered according to the Kabat EU numbering system;

ab) introducing K409D and K392D mutations in the second antibody or fragment thereof, and introducing D399K, E356K, and E357K mutations in the first antibody or fragment thereof, numbered according to the Kabat EU numbering system;

ac) introducing K409D and K392D mutations in the second antibody or fragment thereof, and introducing a D399K mutation in the first antibody or fragment thereof, numbered according to the Kabat EU numbering system;

ad) introducing K409D and K392D mutations in the second antibody or fragment thereof, and introducing D399K and E356K mutations in the first antibody or fragment thereof, numbered according to the Kabat EU numbering system;

ae) introducing K409D and K392D mutations in the second antibody or fragment thereof, and introducing D399K and E357K mutations in the first antibody or fragment thereof, numbered according to the Kabat EU numbering system;

af) introducing K409D and K370D mutations in the second antibody or fragment thereof, and introducing D399K and E357K mutations in the first antibody or fragment thereof, numbered according to the Kabat EU numbering system;

ag) introducing a D399K mutation in the second antibody or fragment thereof, and introducing K409D and K360D mutations in the first antibody or fragment thereof, numbered according to the Kabat EU numbering system; or ah) introducing K409D and K439D mutations in the second antibody or fragment thereof, and introducing D399K and E356K mutations in the first antibody or fragment thereof, numbered according to the Kabat EU numbering system.

191. The masked cytokine of any one of embodiments 168-181, wherein the amino acid sequence of the first antibody or fragment thereof and the amino acid sequence of the second antibody or fragment thereof are produced by:

a) introducing a K409E mutation in the amino acid sequence of SEQ ID NO: 154 or 169, and introducing a D399K mutation in the amino acid sequence of SEQ ID NO: 154 or 169, respectively, numbered according to the Kabat EU numbering system;

b) introducing a K409E mutation in the amino acid sequence of SEQ ID NO: 154 or 169, and introducing a D399R mutation in the amino acid sequence of SEQ ID NO: 154 or 169, respectively, numbered according to the Kabat EU numbering system;

c) introducing a K409D mutation in the amino acid sequence of SEQ ID NO: 154 or 169, and introducing a D399K mutation in the amino acid sequence of SEQ ID NO: 154 or 169, respectively, numbered according to the Kabat EU numbering system;

d) introducing a K409D mutation in the amino acid sequence of SEQ ID NO: 154 or 169, and introducing a D399R mutation in the amino acid sequence of SEQ ID NO: 154 or 169, respectively, numbered according to the Kabat EU numbering system;

e) introducing a K392E mutation in the amino acid sequence of SEQ ID NO: 154 or 169, and introducing a D399R mutation in the amino acid sequence of SEQ ID NO: 154 or 169, respectively, numbered according to the Kabat EU numbering system;

f) introducing a K392E mutation in the amino acid sequence of SEQ ID NO: 154 or 169, and introducing a D399K mutation in the amino acid sequence of SEQ ID NO: 154 or 169, respectively, numbered according to the Kabat EU numbering system;

g) introducing a K392D mutation in the amino acid sequence of SEQ ID NO: 154 or 169, and introducing a D399R mutation in the amino acid sequence of SEQ ID NO: 154 or 169, respectively, numbered according to the Kabat EU numbering system;

h) introducing a K392D mutation in the amino acid sequence of SEQ ID NO: 154 or 169, and introducing a D399K mutation in the amino acid sequence of SEQ ID NO: 154 or 169, respectively, numbered according to the Kabat EU numbering system;

i) introducing K409D and K360D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

j) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

k) introducing K409D and K392D mutations in the amino acid sequence of SEQ ID NO: 154 or 169, and introducing D399K, E356K, and E357K mutations in the amino acid sequence of SEQ ID NO: 154 or 169, respectively, numbered according to the Kabat EU numbering system;

l) introducing K409D and K392D mutations in the amino acid sequence of SEQ ID NO: 154 or 169, and introducing a D399K mutation in the amino acid sequence of SEQ ID NO: 154 or 169, respectively, numbered according to the Kabat EU numbering system;

m) introducing K409D and K392D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

n) introducing K409D and K392D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

o) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

p) introducing a D399K mutation in the amino acid sequence of SEQ ID NO: 154 or 169, and introducing K409D and K360D mutations in the amino acid sequence of SEQ ID NO: 154 or 169, respectively, numbered according to the Kabat EU numbering system;

q) introducing K409D and K439D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

r) introducing a K409E mutation in the amino acid sequence of SEQ ID NO: 154 or 169, and introducing a D399K mutation in the amino acid sequence of SEQ ID NO: 154 or 169, respectively, numbered according to the Kabat EU numbering system;

s) introducing a K409E mutation in the amino acid sequence of SEQ ID NO: 154 or 169, and introducing a D399R mutation in the amino acid sequence of SEQ ID NO: 154 or 169, respectively, numbered according to the Kabat EU numbering system;

t) introducing a K409D mutation in the amino acid sequence of SEQ ID NO: 154 or 169, and introducing a D399K mutation in the amino acid sequence of SEQ ID NO: 154 or 169, respectively, numbered according to the Kabat EU numbering system;

u) introducing a K409D mutation in the amino acid sequence of SEQ ID NO: 154 or 169, and introducing a D399R mutation in the amino acid sequence of SEQ ID NO: 154 or 169, respectively, numbered according to the Kabat EU numbering system;

v) introducing a K392E mutation in the amino acid sequence of SEQ ID NO: 154 or 169, and introducing a D399R mutation in the amino acid sequence of SEQ ID NO: 154 or 169, respectively, numbered according to the Kabat EU numbering system;

w) introducing a K392E mutation in the amino acid sequence of SEQ ID NO: 154 or 169, and introducing a D399K mutation in the amino acid sequence of SEQ ID NO: 154 or 169, respectively, numbered according to the Kabat EU numbering system;

x) introducing a K392D mutation in the amino acid sequence of SEQ ID NO: 154 or 169, and introducing a D399R mutation in the amino acid sequence of SEQ ID NO: 154 or 169, respectively, numbered according to the Kabat EU numbering system;

y) introducing a K392D mutation in the amino acid sequence of SEQ ID NO: 154 or 169, and introducing a D399K mutation in the amino acid sequence of SEQ ID NO: 154 or 169, respectively, numbered according to the Kabat EU numbering system;

z) introducing K409D and K360D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

aa) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

ab) introducing K409D and K392D mutations in the amino acid sequence of SEQ ID NO: 154 or 169, and introducing D399K, E356K, and E357K mutations in the amino acid sequence of SEQ ID NO: 154 or 169, respectively, numbered according to the Kabat EU numbering system;

ac) introducing K409D and K392D mutations in the amino acid sequence of SEQ ID NO: 154 or 169, and introducing a D399K mutation in the amino acid sequence of SEQ ID NO: 154 or 169, respectively, numbered according to the Kabat EU numbering system;

ad) introducing K409D and K392D mutations in the amino acid sequence of SEQ ID NO: 154 or 169, and introducing D399K and E356K mutations in the amino acid sequence of SEQ ID NO: 154 or 169, numbered according to the Kabat EU numbering system;

ae) introducing K409D and K392D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

af) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

ag) introducing a D399K mutation in the amino acid sequence of SEQ ID NO: 154 or 169, and introducing K409D and K360D mutations in the amino acid sequence of SEQ ID NO: 154 or 169, respectively, numbered according to the Kabat EU numbering system; or ah) introducing K409D and K439D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system.

192. The masked cytokine of any one of embodiments 150-191, wherein the first linker comprises a first cleavable peptide; and/or wherein the second linker comprises a second cleavable peptide.

193. The masked cytokine of any one of embodiments 150-192, wherein the first linker comprises a first N-terminal spacer domain, and/or a first C-terminal spacer domain.

194. The masked cytokine of embodiment 193, wherein the first linker comprises:
a) the first N-terminal spacer domain, the first cleavable peptide, and the first C-terminal spacer domain;
b) the first N-terminal spacer domain and the first cleavable peptide;
c) the first N-terminal spacer domain and the first C-terminal spacer domain;
d) the first cleavable peptide and the first C-terminal spacer domain;
e) the first N-terminal spacer domain; or
f) the first C-terminal spacer domain.

195. The masked cytokine of any one of embodiments 150-194, wherein the second linker comprises a second N-terminal spacer domain, and/or a second C-terminal spacer domain.

196. The masked cytokine of embodiment 195, wherein the second linker comprises:
a) the second N-terminal spacer domain, the second cleavable peptide, and the second C-terminal spacer domain;
b) the second N-terminal spacer domain and the second cleavable peptide;
c) the second N-terminal spacer domain and the second C-terminal spacer domain;
d) the second cleavable peptide and the second C-terminal spacer domain;
e) the second N-terminal spacer domain; or
f) the second C-terminal spacer domain.

197. The masked cytokine of any one of embodiments 192-196, wherein the first cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555; and/or wherein the second cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555.

198. The masked cytokine of any one of embodiments 193-197, wherein the first N-terminal spacer domain comprises an amino acid sequence selected from the group consisting of SEQ ID NOs: 20-95 235, 263, 268, 269, 727, 794, 799, and 857-878, and/or the first C-terminal spacer domain comprises an amino acid sequence selected from the group consisting of SEQ ID NOs: 20-95, 235, 268, 269, 303-305, 323-338, 340, 341, 727, 794, and 799.

199. The masked cytokine of any one of embodiments 192-196, wherein the first cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

200. The masked cytokine of embodiment 199, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

201. The masked cytokine of any one of embodiments 195-200, wherein the second N-terminal spacer domain comprises an amino acid sequence selected from the group consisting of SEQ ID NOs: 20-95, 235, 268, 269, 303-305, 323-338, 340, 341, 727, 794, and 799, and/or the second C-terminal spacer domain comprises an amino acid sequence selected from the group consisting of SEQ ID NOs: 20-95, 235, 268, 269, 303-305, 323-338, 340, 341, 727, 794, and 799.

202. The masked cytokine of any one of embodiments 192-201, wherein the second cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

203. The masked cytokine of embodiment 202, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

204. The masked cytokine of any one of embodiments 150-203, wherein the first linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812, and/or the second linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812.

205. The masked cytokine of any one of embodiments 184-204, wherein the third linker comprises a third N-terminal spacer domain, and/or a third C-terminal spacer domain.

206. The masked cytokine of embodiment 205, wherein the third N-terminal spacer domain comprises an amino acid sequence selected from the group consisting of SEQ ID NOs: 20-95, 235, 268, 269, 303-305, 323-338, 340, 341, 727, 794, and 799, and/or the third C-terminal spacer domain comprises an amino acid sequence selected from the group consisting of SEQ ID NOs: 20-95, 235, 268, 269, 303-305, 323-338, 340, 341, 727, 794, and 799.

207. The masked cytokine of any one of embodiments 192-206, wherein the first cleavable peptide and/or the second cleavable peptide is a substrate for a protease that is co-localized in a region or a tissue expressing a cytokine receptor.

208. The masked cytokine of embodiment 207, wherein the cytokine receptor is an IL-2 cytokine receptor or an IL-15 cytokine receptor.

209. The masked cytokine of any one of embodiments 184-208, wherein the first cleavable peptide and/or the second cleavable peptide is cleaved by one or more enzyme selected from the group consisting of: ABHD12, ADAM12, ABHD12B, ABHD13, ABHD17A, ADAM19, ADAM20, ADAM21, ADAM28, ADAM30, ADAM33, ADAM8, ABHD17A, ADAMDEC1, ADAMTS1, ADAMTS10, ADAMTS12, ADAMTS13, ADAMTS14, ADAMTS15, ADAMTS16, ADAMTS17, ADAMTS18, ADAMTS19, ADAMTS2, ADAMTS20, ADAMTS3, ADAMTS4, ABHD17B, ADAMTS5, ADAMTS6, ADAMTS7, ADAMTS8, ADAMTS9, ADAMTSL1, ADAMTSL2, ADAMTSL3, ABHD17C, ADAMTSL5, ASTL, BMP1, CELA1, CELA2A, CELA2B, CELA3A, CELA3B, ADAM10, ADAM15, ADAM17, ADAM9, ADAMTS4, CTSE, CTSF, ADAMTSL4, CMA1, CTRB1, CTRC, CTSO, CTR1, CTSA, CTSW, CTSB, CTSC, CTSD, ESP1, CTSG, CTSH, GZMA, GZMB, GZMH, CTSK, GZMM, CTSL, CTSS, CTSV, CTSZ, HTRA4, KLK10, KLK11, KLK13, KLK14, KLK2, KLK4, DPP4, KLK6, KLK7, KLKB1, ECE1, ECE2, ECEL1, MASP2, MEP1A, MEP1B, ELANE, FAP, GZMA, MMP11, GZMK, HGFAC, HPN, HTRA1, MMP11, MMP16, MMP17, MMP19, HTRA2, MMP20, MMP21, HTRA3, HTRA4, KEL, MMP23B, MMP24, MMP25, MMP26, MMP27, MMP28, KLK5, MMP3, MMP1, MMP8, MMP9, LGMN, LNPEP, MASP1, PAPPA, PAPPA2, PCSK1, NAPSA, PCSK5, PCSK6, MME, MMP1, MMP10, PLAT, PLAU, PLG, PRSS1, PRSS12, PRSS2, PRSS21, PRSS3, PRSS33, PRSS4, PRSS55, PRSS57, MMP12, PRSS8, PRSS9, PRTN3, MMP13, MMP14, ST14, TMPRSS10, TMPRSS11A, TMPRSS11D, TMPRSS11E, TMPRSS11F, TMPRSS12, TMPRSS13, MMP15, TMPRSS15, MMP2, TMPRSS2, TMPRSS3, TMPRSS4, TMPRSS5, TMPRSS6, TMPRSS7, TMPRSS9, NRDC, OVCH1, PAMR1, PCSK3, PHEX, TINAG, TPSAB1, TPSD1, and TPSG1.

210. The masked cytokine of any one of embodiments 149-209, wherein the first half-life extension domain and/or the second half-life extension domain is conjugated to an agent.

211. The masked cytokine of embodiment 210, wherein the agent is an inhibitor of tubulin polymerization, a DNA damaging agent, or a DNA synthesis inhibitor.

212. The masked cytokine of embodiment 211, wherein the agent is a maytansinoid, an auristatin, a pyrrolobenzodiazepine (PBD) dimer, a calicheamicin, a duocarmycin, a indo-linobenzodiazepine dimer or exatecan derivative Dxd.

213. The masked cytokine of embodiment 210, wherein the agent is an immune stimulant.

214. The masked cytokine of embodiment 213, wherein the immune stimulant is a stimulator of interferon genes (STING) agonist or a toll-like receptor (TLR) agonist.

215. The masked cytokine of embodiment 214, wherein the STING agonist is a cyclic dinucleotide (CDN).

216. The masked cytokine of embodiment 215, wherein the CDN is selected from the group consisting of cGAMP, c-di-AMP, c-di-GMP, cAIMP, c-di-IMP, 4-(2-chloro-6-fluorobenzyl)-N-(furan-2-ylmethyl)-3-oxo-3,4-dihydro-2H-benzo[b][1,4]thiazine-6-carboxamide.

217. The masked cytokine of embodiment 214, wherein the TLR agonist is an agonist of a TLR selected from the group consisting of TLR1, TLR2, TLR3, TLR4, TLR5, TLR6, TLR7, TLR8, TLR9, and TLR10.

218. A masked cytokine comprising:
a) a first half-life extension domain and a second half-life extension domain;
b) a first masking moiety and a second masking moiety; and
c) a cytokine or functional fragment thereof,
wherein the first masking moiety is linked to the first half-life extension domain,
wherein the second masking moiety is linked to the cytokine or functional fragment thereof,
wherein either the second masking moiety or the cytokine or functional fragment thereof is linked to the second half-life extension domain, and
wherein the first half-life extension domain and the second half-life extension domain contain modifications promoting the association of the first and the second half-life extension domain.

219. The masked cytokine of embodiment 218, wherein:
a) the first masking moiety is linked to the first half-life extension domain via a first linker; and/or
b) either the second masking moiety or the cytokine or functional fragment thereof is linked to the second half-life extension domain via a second linker.

220. The masked cytokine of embodiment 218 or embodiment 219, wherein the second masking moiety is linked to the cytokine or functional fragment thereof via a third linker.

221. The masked cytokine of any one of embodiments 218-220, wherein the cytokine or functional fragment thereof is an IL-2 polypeptide or functional fragment thereof.

222. The masked cytokine of embodiment 221, wherein the IL-2 polypeptide or functional fragment thereof comprises an amino acid sequence selected from the group consisting of SEQ ID NOs: 1-8, 160, 243-251, 230, 243-251, 260, 775-792, and 813-822.

223. The masked cytokine of embodiment 221, wherein the IL-2 polypeptide or functional fragment thereof comprises an amino acid sequence produced by introducing one or more amino acid substitutions into the amino acid sequence of the IL-2 polypeptide or functional fragment thereof that reduces the affinity of the IL-2 polypeptide or functional fragment thereof for CD25 (IL-2Rα).

224. The masked cytokine of embodiment 223, wherein the amino acid sequence is produced by introducing one or more of the following amino acid substitutions into any one of SEQ ID NOs: 1-8, 160, 243-251, 260, 775-792, and 813-822: R38A, F42A, F42K, F42E, K43A, Y45A, Y45N, Y45R, E62A, E62R, E62S, and L72G.

225. The masked cytokine of embodiment 221, wherein the IL-2 polypeptide or functional fragment thereof comprises an amino acid sequence produced by introducing one or more amino acid substitutions into the amino acid sequence of the IL-2 polypeptide or functional fragment thereof that increases the affinity of the IL-2 polypeptide or functional fragment thereof for IL-2Rβ or IL-2Rγ.

226. The masked cytokine of embodiment 225, wherein the amino acid sequence is produced by introducing one or more of the following amino acid substitutions into any one of SEQ ID NOs: 1-8, 160, 243-251, 260, 775-792, and 813-822: H16I, L18C, D20A, D20L, D20F, N29L, L80F, R81D, L85V, I86V, and I92F.

227. The masked cytokine of embodiment 223 or embodiment 224, wherein the amino acid sequence is produced by further introducing one or more amino acid substitutions that increase the affinity of the IL-2 polypeptide or functional fragment thereof for IL-2Rβ or IL-2Rγ.

228. The masked cytokine of embodiment 227, wherein the one or more amino acid substitutions that increase the affinity of the IL-2 polypeptide or functional fragment thereof for IL-2Rβ or IL-2Rγ is selected from the group consisting of H16I, L18C, D20A, D20L, D20F, N29L, L80F, R81D, L85V, I86V, and I92F.

229. The masked cytokine of embodiment 221, wherein the IL-2 polypeptide or functional fragment thereof comprises an amino acid sequence produced by introducing one or more amino acid substitutions into the amino acid sequence of the IL-2 polypeptide or functional fragment thereof that stabilizes the IL-2 polypeptide or functional fragment thereof.

230. The masked cytokine of embodiment 229, wherein the amino acid sequence is produced by introducing one of the following amino acid substitutions into any one of SEQ ID NOs: 1-8, 160, 243-251, 260, 775-792, and 813-822: C125S, C125A, and C125G.

231. The masked cytokine of any one of embodiments 223-228, wherein the amino acid sequence is produced by further introducing one or more amino acid substitutions that stabilize the IL-2 polypeptide or functional fragment thereof.

232. The masked cytokine of embodiment 231, wherein the one or more amino acid substitutions that stabilize the IL-2 polypeptide or functional fragment thereof is the amino acid substitution C125S, C125A, or C125G.

233. The masked cytokine of any one of embodiments 221-232, wherein the first masking moiety comprises an amino acid sequence selected from the group consisting of SEQ ID NOs: 9, 10, 161-165, 187-218, 221-229, 231, 261, 826 and 827 and the second masking moiety comprises an amino acid sequence selected from the group consisting of SEQ ID NOs: 9, 10, 161-165, 187-218, 221-229, 231, 261, 826 and 827 and wherein the amino acid sequence of the first masking moiety and the second masking moiety are different.

234. The masked cytokine of any one of embodiments 221-233, wherein:

a) the first masking moiety comprises the amino acid sequence of SEQ ID NO: 9 or 231, and the second masking moiety comprises an amino acid sequence selected from the group consisting of SEQ ID NOs: 10, 161-165, 187-218, 221-226, 261, 826 and 827; or b) the first masking moiety comprises an amino acid sequence selected from the group consisting of SEQ ID NOs: 10, 161-165, 187-218, 221-226, 261, 826 and 827, and the second masking moiety comprises the amino acid sequence of SEQ ID NO: 9 or 231.

235. The masked cytokine of any one of embodiments 218-220, wherein the cytokine or functional fragment thereof is an IL-15 polypeptide or functional fragment thereof.

236. The masked cytokine of embodiment 235, wherein the IL-15 polypeptide or functional fragment thereof comprises the amino acid sequence of SEQ ID NO: 167.

237. The masked cytokine of embodiment 235 or embodiment 236, wherein a) the first masking moiety comprises an amino acid sequence selected from the group consisting of SEQ ID NOs: 232-234, and 823-825, and the second masking moiety comprises an amino acid sequence selected from the group consisting of SEQ ID NOs: 10, 161-165, 219-229, 261, 826 and 827;

b) the first masking moiety comprises an amino acid sequence selected from the group consisting of SEQ ID NOs: 10, 161-165, 219-229, 261, 826 and 827, and the second masking moiety comprises an amino acid sequence selected from the group consisting of SEQ ID NOs: 232-234, and 823-825;

c) the first masking moiety comprises an amino acid sequence produced by introducing one or more of the following amino acid substitutions into the amino acid sequence of any one of SEQ ID NOs: 232-234, and 823-825: R24A, R26A, K34A, S40A, L42A, and P67A, and the second masking moiety comprises an amino acid sequence selected from the group consisting of SEQ ID NOs: 10, 161-165, 219-229, 261, 826 and 827; or d) the first masking moiety comprises an amino acid sequence selected from the group consisting of SEQ ID NOs: 10, 161-165, 219-229, 261, 826 and 827, and the second masking moiety comprises an amino acid sequence produced by introducing one or more of the following amino acid substitutions into the amino acid sequence of any one of SEQ ID NOs: 232-234, and 823-825: R24A, R26A, K34A, S40A, L42A, and P67A.

238. The masked cytokine of any one of embodiments 218-237, wherein the first half-life extension domain is a first antibody or fragment thereof, and the second half-life extension domain is a second antibody or fragment thereof.

239. The masked cytokine of embodiment 238, wherein:

a) the first antibody or fragment thereof comprises a first heavy chain polypeptide, and the second antibody or fragment thereof comprises a second light chain polypeptide; or b) the first antibody or fragment thereof comprises a first light chain polypeptide, and the second antibody or fragment thereof comprises a second heavy chain polypeptide.

240. The masked cytokine of embodiment 239, wherein the first heavy chain polypeptide, or the second heavy chain polypeptide comprises one or more amino acid substitutions altering effector function.

241. The masked cytokine of embodiment 240, wherein the first heavy chain polypeptide or the second heavy chain polypeptide:

a) is an IgG1 isotype and comprises the amino substitution(s):
  i) N297A, N297G, or N297Q;
  ii) L234A and L235A;
  iii) C220S, C226S, C229S, and P238S;
  iv) C226S, C229S, E233P, L234V, and L235A;
  v) L234F, L235E, and P331S;
  vi) S267E and L328F;
  vii) D265A;
  viii) L234A, L235A, and P329G;
b) is an IgG2 isotype and comprises the amino acid substitution(s):
  i) V234A and G237A;
  ii) H268Q, V309L, A330S, and A331S; or
  iii) V234A, G237A, P238S, H268A, V309L, A330S, and P331S; or
e) is an IgG4 isotype and comprises the amino acid substitution(s):
  i) L235A, G237A, and E318A;
  ii) S228P, L234A, and L235A;
  iii) H268Q, V309L, A330S, and P331S; or
  iv) S228P and L235A, numbered according to the Kabat EU numbering system.

242. The masked cytokine of embodiment 240, wherein the first heavy chain polypeptide or the second heavy chain polypeptide comprises one or more amino acid substitutions enhancing effector function.

243. The masked cytokine of embodiment 242, wherein the first heavy chain polypeptide or the second heavy chain polypeptide is an IgG1 heavy chain polypeptide and comprises the amino acid substitution(s):
a) S298A, E333A, and K334A;
b) S239D and I332E;
c) S239D, A330L, and I332E;
d) P247I and A339D or A339Q;
e) D280H and K290S;
f) D280H, K290S, and either S298D or S298V;
g) F243L, R292P, and Y300L;
h) F243L, R292P, Y300L, and P396L;
i) F243L, R292P, Y300L, V305I, and P396L;
j) G236A, S239D, and I332E;
k) K326A and E333A;
l) K326W and E333S;
m) K290E, S298G, and T299A;
n) K290E, S298G, T299A, and K326E;
o) K290N, S298G, and T299A;
p) K290N, S298G, T299A, and K326E;
q) K334V;
r) L235S, S239D, and K334V;
s) K334V and Q331M, S239D, F243V, E294L, or S298T;
t) E233L, Q311M, and K334V;
u) L234I, Q311M, and K334V;
v) K334V and S298T, A330M, or A330F;
w) K334V, Q311M, and either A330M or A330F;
x) K334V, S298T, and either A330M or A330F;
y) K334V, S239D, and either A330M or S298T;
z) L234Y, Y296W, and K290Y, F243V, or E294L;
aa) Y296W and either L234Y or K290Y;
ab) S239D, A330S, and I332E,
ac) V264I;
ad) F243L and V264I;
ae) L328M;
af) I332E;
ag) L328M and I332E;
ah) V264I and I332E;
ai) S239E and I332E;
aj) S239Q and I332E;
ak) S239E;
al) A330Y;
am) I332D;
an) L328I and I332E;
ao) L328Q and I332E;
ap) V264T;
aq) V240I;
ar) V266I;
as) S239D;
at) S239D and I332D;
au) S239D and I332N;
av) S239D and I332Q;
aw) S239E and I332D;
ax) S239E and I332N;
ay) S239E and I332Q;
az) S239N and I332D;
ba) S239N and I332E;
bb) S239Q and I332D;
bc) A330Y and I332E;
bd) V264I, A330Y, and I332E;
be) A330L and I332E;
bf) V264I, A330L, and I332E;
bg) L234E, L234Y, or L234I;
bh) L235D, L235S, L235Y, or L235I;
bi) S239T;
bj) V240M;
bk) V264Y;
bl) A330I;
bm) N325T;
bn) I332E and L328D, L328V, L328T, or L328I;
bo) V264I, I332E, and either S239E or S239Q;
bp) S239E, V264I, A330Y, and I332E;
bq) A330Y, I332E, and either S239D or S239N;
br) A330L, I332E, and either S239D or S239N;
bs) V264I, S298A, and I332E;
bt) S298A, I332E, and either S239D or S239N;
bu) S239D, V264I, and I332E;
by) S239D, V264I, S298A, and I332E;
bw) S239D, V264I, A330L, and I332E;
bx) S239D, I332E, and A330I;
by) P230A;
bz) P230A, E233D, and I332E;
ca) E272Y;
cb) K274T, K274E, K274R, K274L, or K274Y;
cd) F275W;
ce) N276L;
cf) Y278T;
cg) V302I;
ch) E318R;
ci) S324D, S324I or S324V;
cj) K326I or K326T;
ck) T335D, T335R, or T335Y;
cl) V240I and V266I;
cm) S239D, A330Y, I332E, and L234I;
cn) S239D, A330Y, I332E, and L235D;
co) S239D, A330Y, I332E, and V240I;
cp) S239D, A330Y, I332E, and V264T; or
cq) S239D, A330Y, I332E, and either K326E or K326T,
numbered according to the Kabat EU numbering system.

244. The masked cytokine of embodiment 239, wherein the first heavy chain polypeptide comprises an amino acid sequence selected from the group consisting of SEQ ID NOs: 158, 168, and 169, and the second heavy chain polypeptide comprises an amino acid sequence selected from the group consisting of SEQ ID NOs: 158, 168, and 169.

245. The masked cytokine of embodiment 239, wherein the first light chain polypeptide comprises the amino acid sequence of SEQ ID NO: 157 or 170, and the second light chain polypeptide comprises the amino acid sequence of SEQ ID NO: 157 or 170.

246. The masked cytokine of embodiment 238, wherein the first antibody or fragment thereof is a first Fragment crystallizable domain (Fc domain) or fragment thereof, and the second antibody or fragment thereof is a second Fc domain or fragment thereof.

247. The masked cytokine of embodiment 246, wherein the first Fc domain or fragment thereof, and/or the second Fc domain or fragment thereof comprises one or more amino acid substitutions altering effector function.

248. The masked cytokine of embodiment 247, wherein the first Fc domain or fragment thereof and/or the second Fc domain or fragment thereof:
   a) is an IgG1 Fc domain or fragment thereof and comprises the amino substitution(s):
      i) N297A, N297G, or N297Q;
      ii) L234A and L235A;
      iii) C220S, C226S, C229S, and P238S;
      iv) C226S, C229S, E233P, L234V, and L235A;
      v) L234F, L235E, and P331S;
      vi) S267E and L328F;
      vii) D265A;
      viii) L234A, L235A, and P329G;
   b) is an IgG2 Fc domain or fragment thereof and comprises the amino acid substitution(s):
      i) V234A and G237A;
      ii) H268Q, V309L, A330S, and A331S; or
      iii) V234A, G237A, P238S, H268A, V309L, A330S, and P331S; or
   e) is an IgG4 Fc domain or fragment thereof and comprises the amino acid substitution(s):
      i) L235A, G237A, and E318A;
      ii) S228P, L234A, and L235A;
      iii) H268Q, V309L, A330S, and P331S; or
      iv) S228P and L235A, numbered according to the Kabat EU numbering system.

249. The masked cytokine of embodiment 247, wherein first Fc domain or fragment thereof, and/or the second Fc domain or fragment thereof comprises one or more amino acid substitutions enhancing effector function.

250. The masked cytokine of embodiment 249, wherein the first Fc domain or fragment thereof, and/or the second Fc domain or fragment thereof is an IgG1 Fc domain or fragment thereof and comprises the amino acid substitution(s):
   a) S298A, E333A, and K334A;
   b) S239D and I332E;
   c) S239D, A330L, and I332E;
   d) P247I and A339D or A339Q;
   e) D280H and K290S;
   f) D280H, K290S, and either S298D or S298V;
   g) F243L, R292P, and Y300L;
   h) F243L, R292P, Y300L, and P396L;
   i) F243L, R292P, Y300L, V305I, and P396L;
   j) G236A, S239D, and I332E;
   k) K326A and E333A;
   l) K326W and E333S;
   m) K290E, S298G, and T299A;
   n) K290E, S298G, T299A, and K326E;
   o) K290N, S298G, and T299A;
   p) K290N, S298G, T299A, and K326E;
   q) K334V;
   r) L235S, S239D, and K334V;
   s) K334V and Q331M, S239D, F243V, E294L, or S298T;
   t) E233L, Q311M, and K334V;
   u) L234I, Q311M, and K334V;
   v) K334V and S298T, A330M, or A330F;
   w) K334V, Q311M, and either A330M or A330F;
   x) K334V, S298T, and either A330M or A330F;
   y) K334V, S239D, and either A330M or S298T;
   z) L234Y, Y296W, and K290Y, F243V, or E294L;
   aa) Y296W and either L234Y or K290Y;
   ab) S239D, A330S, and I332E,
   ac) V264I;
   ad) F243L and V264I;
   ae) L328M;
   af) I332E;
   ag) L328M and I332E;
   ah) V264I and I332E;
   ai) S239E and I332E;
   aj) S239Q and I332E;
   ak) S239E;
   al) A330Y;
   am) I332D;
   an) L328I and I332E;
   ao) L328Q and I332E;
   ap) V264T;
   aq) V240I;
   ar) V266I;
   as) S239D;
   at) S239D and I332D;
   au) S239D and I332N;
   av) S239D and I332Q;
   aw) S239E and I332D;
   ax) S239E and I332N;
   ay) S239E and I332Q;
   az) S239N and I332D;
   ba) S239N and I332E;
   bb) S239Q and I332D;
   bc) A330Y and I332E;
   bd) V264I, A330Y, and I332E;
   be) A330L and I332E;
   bf) V264I, A330L, and I332E;
   bg) L234E, L234Y, or L234I;
   bh) L235D, L235S, L235Y, or L235I;
   bi) S239T;
   bj) V240M;
   bk) V264Y;
   bl) A330I;
   bm) N325T;
   bn) I332E and L328D, L328V, L328T, or L328I;
   bo) V264I, I332E, and either S239E or S239Q;
   bp) S239E, V264I, A330Y, and I332E;
   bq) A330Y, I332E, and either S239D or S239N;
   br) A330L, I332E, and either S239D or S239N;
   bs) V264I, S298A, and I332E;
   bt) S298A, I332E, and either S239D or S239N;
   bu) S239D, V264I, and I332E;
   bv) S239D, V264I, S298A, and I332E;
   bw) S239D, V264I, A330L, and I332E;
   bx) S239D, I332E, and A330I;
   by) P230A;
   bz) P230A, E233D, and I332E;
   ca) E272Y;
   cb) K274T, K274E, K274R, K274L, or K274Y;
   cd) F275W;
   ce) N276L;
   cf) Y278T;
   cg) V302I;
   ch) E318R;

ci) S324D, S324I or S324V;
cj) K326I or K326T;
ck) T335D, T335R, or T335Y;
cl) V240I and V266I;
cm) S239D, A330Y, I332E, and L234I;
cn) S239D, A330Y, I332E, and L235D;
co) S239D, A330Y, I332E, and V240I;
cp) S239D, A330Y, I332E, and V264T; or
cq) S239D, A330Y, I332E, and either K326E or K326T, numbered according to the Kabat EU numbering system.

251. The masked cytokine of embodiment 246, wherein:
a) the first Fc domain or fragment thereof comprises the amino acid sequence of SEQ ID NO: 155, and the second Fc domain or fragment thereof comprises the amino acid sequence of SEQ ID NO: 156;
b) the first Fc domain or fragment thereof comprises the amino acid sequence of SEQ ID NO: 156, and the second Fc domain or fragment thereof comprises the amino acid sequence of SEQ ID NO: 155;
c) the first Fc domain or fragment thereof comprises the amino acid sequence of SEQ ID NO: 154, and the second Fc domain or fragment thereof comprises the amino acid sequence of SEQ ID NO: 154;
d) the first Fc domain or fragment thereof comprises the amino acid sequence of SEQ ID NO: 265, and the second Fc domain or fragment thereof comprises the amino acid sequence of SEQ ID NO: 156;
e) the first Fc domain or fragment thereof comprises the amino acid sequence of SEQ ID NO: 156, and the second Fc domain or fragment thereof comprises the amino acid sequence of SEQ ID NO: 265;
f) the first Fc domain or fragment thereof comprises the amino acid sequence of SEQ ID NO: 155, and the second Fc domain or fragment thereof comprises the amino acid sequence of SEQ ID NO: 616;
g) the first Fc domain or fragment thereof comprises the amino acid sequence of SEQ ID NO: 616, and the second Fc domain or fragment thereof comprises the amino acid sequence of SEQ ID NO: 155;
h) the first Fc domain or fragment thereof comprises the amino acid sequence of SEQ ID NO: 157, and the second Fc domain or fragment thereof comprises the amino acid sequence of SEQ ID NO: 158;
i) the first Fc domain or fragment thereof comprises the amino acid sequence of SEQ ID NO: 158, and the second Fc domain or fragment thereof comprises the amino acid sequence of SEQ ID NO: 157;
j) the first Fc domain or fragment thereof comprises the amino acid sequence of SEQ ID NO: 796, and the second Fc domain or fragment thereof comprises the amino acid sequence of SEQ ID NO: 774;
k) the first Fc domain or fragment thereof comprises the amino acid sequence of SEQ ID NO: 774, and the second Fc domain or fragment thereof comprises the amino acid sequence of SEQ ID NO: 796;
l) the first Fc domain or fragment thereof comprises the amino acid sequence of SEQ ID NO: 721, and the second Fc domain or fragment thereof comprises the amino acid sequence of SEQ ID NO: 619;
m) the first Fc domain or fragment thereof comprises the amino acid sequence of SEQ ID NO: 619, and the second Fc domain or fragment thereof comprises the amino acid sequence of SEQ ID NO: 721;
n) the first Fc domain or fragment thereof comprises the amino acid sequence of SEQ ID NO: 721, and the second Fc domain or fragment thereof comprises the amino acid sequence of SEQ ID NO: 772;
o) the first Fc domain or fragment thereof comprises the amino acid sequence of SEQ ID NO: 772, and the second Fc domain or fragment thereof comprises the amino acid sequence of SEQ ID NO: 721;
p) the first Fc domain or fragment thereof comprises the amino acid sequence of SEQ ID NO: 793, and the second Fc domain or fragment thereof comprises the amino acid sequence of SEQ ID NO: 622;
q) the first Fc domain or fragment thereof comprises the amino acid sequence of SEQ ID NO: 622, and the second Fc domain or fragment thereof comprises the amino acid sequence of SEQ ID NO: 793;
r) the first Fc domain or fragment thereof comprises the amino acid sequence of SEQ ID NO: 793, and the second Fc domain or fragment thereof comprises the amino acid sequence of SEQ ID NO: 773;
s) the first Fc domain or fragment thereof comprises the amino acid sequence of SEQ ID NO: 773, and the second Fc domain or fragment thereof comprises the amino acid sequence of SEQ ID NO: 793;
t) the first Fc domain or fragment thereof comprises the amino acid sequence of SEQ ID NO: 796, and the second Fc domain or fragment thereof comprises the amino acid sequence of SEQ ID NO: 625;
u) the first Fc domain or fragment thereof comprises the amino acid sequence of SEQ ID NO: 625, and the second Fc domain or fragment thereof comprises the amino acid sequence of SEQ ID NO: 796;
v) the first Fc domain or fragment thereof comprises the amino acid sequence of SEQ ID NO: 156, and the second Fc domain or fragment thereof comprises the amino acid sequence of SEQ ID NO: 156;
w) the first Fc domain or fragment thereof comprises the amino acid sequence of SEQ ID NO: 796, and the second Fc domain or fragment thereof comprises the amino acid sequence of SEQ ID NO: 625; or
x) the first Fc domain or fragment thereof comprises the amino acid sequence of SEQ ID NO: 625, and the second Fc domain or fragment thereof comprises the amino acid sequence of SEQ ID NO: 796.

252. The masked cytokine of any one of embodiments 218-237, wherein the first half-life extension domain is a first scFv or fragment thereof, and the second half-life extension domain is a second scFv or fragment thereof.

253. The masked cytokine of any one of embodiments 218-237, wherein the first half-life extension domain is a first Fc domain or fragment thereof, and the second half-life extension domain is a second Fc domain or fragment thereof, and wherein the first Fc domain or fragment thereof is linked to the second Fc domain or fragment thereof.

254. The masked cytokine of embodiment 253, wherein the first Fc domain or fragment thereof is linked to the second Fc domain or fragment thereof via a fourth linker.

255. The masked cytokine of any one of embodiments 218-237, wherein:
a) the first half-life extension domain is an scFv or fragment thereof, and the second half-life extension domain is an antibody or fragment thereof; or
a) the first half-life extension domain is an antibody or fragment thereof, and the second half-life extension domain is an scFv or fragment thereof.

256. The masked cytokine of any one of embodiments 238-251, wherein the modifications promoting the association of the first and the second half-life extension domain comprise:
a) introducing S354C and T366W mutations in the first antibody or fragment thereof, and introducing Y349C, T366S, L368A, and Y407V mutations in the second antibody or fragment thereof, numbered according to the Kabat EU numbering system;

b) introducing S354C and T366W mutations in the second antibody or fragment thereof, and introducing Y349C, T366S, L368A, and Y407V mutations in the first antibody or fragment thereof, numbered according to the Kabat EU numbering system;

c) introducing K392D and K409D mutations in the first antibody or fragment thereof, and introducing D399K and E356K mutations in the second antibody or fragment thereof, numbered according to the Kabat EU numbering system;

d) introducing K392D and K409D mutations in the second antibody or fragment thereof, and introducing D399K and E356K mutations in the first antibody or fragment thereof, numbered according to the Kabat EU numbering system;

e) introducing S364H and F405A mutations in the first antibody or fragment thereof, and introducing Y349T and T394F mutations in the second antibody or fragment thereof, numbered according to the Kabat EU numbering system; or f) introducing S364H and F405A mutations in the second antibody or fragment thereof, and introducing Y349T and T394F mutations in the first antibody or fragment thereof, numbered according to the Kabat EU numbering system.

257. The masked cytokine of any one of embodiments 238-251, wherein the amino acid sequence of the first antibody or fragment thereof and the amino acid sequence of the second antibody or fragment thereof are produced by:

a) introducing S354C and T366W mutations in the amino acid sequence of SEQ ID NO: 154 or 169, and introducing Y349C, T366S, L368A, and Y407V mutations in the amino acid sequence of SEQ ID NO: 154 or 169, respectively, numbered according to the Kabat EU numbering system;

b) introducing S354C and T366W mutations in the amino acid sequence of SEQ ID NO: 154 or 169, and introducing Y349C, T366S, L368A, and Y407V mutations in the amino acid sequence of SEQ ID NO: 154 or 169, respectively, numbered according to the Kabat EU numbering system;

c) introducing K392D and K409D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

d) introducing K392D and K409D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

e) introducing S364H and F405A mutations in the amino acid sequence of SEQ ID NO: 154 or 169, and introducing Y349T and T394F mutations in the amino acid sequence of SEQ ID NO: 154 or 169, respectively, numbered according to the Kabat EU numbering system; or f) introducing S364H and F405A mutations in the amino acid sequence of SEQ ID NO: 154 or 169, and introducing Y349T and T394F mutations in the amino acid sequence of SEQ ID NO: 154 or 169, respectively, numbered according to the Kabat EU numbering system.

258. The masked cytokine of any one of embodiments 238-251, wherein the modifications promoting the association of the first and the second half-life extension domain comprise:

a) introducing a Y407T mutation in the first antibody or fragment thereof, and introducing a T366Y mutation in the second antibody or fragment thereof, numbered according to the Kabat EU numbering system;

b) introducing a Y407A mutation in the first antibody or fragment thereof, and introducing a T366W mutation in the second antibody or fragment thereof, numbered according to the Kabat EU numbering system;

c) introducing a F405A mutation in the first antibody or fragment thereof, and introducing a T394W mutation in the second antibody or fragment thereof, numbered according to the Kabat EU numbering system;

d) introducing a F405W mutation in the first antibody or fragment thereof, and introducing a T394S mutation in the second antibody or fragment thereof, numbered according to the Kabat EU numbering system;

e) introducing a Y407T mutation in the first antibody or fragment thereof, and introducing a T366Y mutation in the second antibody or fragment thereof, numbered according to the Kabat EU numbering system;

f) introducing T366Y and F405A mutations in the first antibody or fragment thereof, and introducing T394W and Y407T mutations in the second antibody or fragment thereof, numbered according to the Kabat EU numbering system;

g) introducing T366W and F405W mutations in the first antibody or fragment thereof, and introducing T394S and Y407A mutations in the second antibody or fragment thereof, numbered according to the Kabat EU numbering system;

h) introducing F405W and Y407A mutations in the first antibody or fragment thereof, and introducing T366W and T394S mutations in the second antibody or fragment thereof, numbered according to the Kabat EU numbering system;

i) introducing a T366W mutation in the first antibody or fragment thereof, and introducing T366S, L368A, and Y407V mutations in the second antibody or fragment thereof, numbered according to the Kabat EU numbering system;

j) introducing a Y407T mutation in the second antibody or fragment thereof, and introducing a T366Y mutation in the first antibody or fragment thereof, numbered according to the Kabat EU numbering system;

k) introducing a Y407A mutation in the second antibody or fragment thereof, and introducing a T366W mutation in the first antibody or fragment thereof, numbered according to the Kabat EU numbering system;

l) introducing a F405A mutation in the second antibody or fragment thereof, and introducing a T394W mutation in the first antibody or fragment thereof, numbered according to the Kabat EU numbering system;

m) introducing a F405W mutation in the second antibody or fragment thereof, and introducing a T394S mutation in the first antibody or fragment thereof, numbered according to the Kabat EU numbering system;

n) introducing a Y407T mutation in the second antibody or fragment thereof, and introducing a T366Y mutation in the first antibody or fragment thereof, numbered according to the Kabat EU numbering system;

o) introducing T366Y and F405A mutations in the second antibody or fragment thereof, and introducing T394W and Y407T mutations in the first antibody or fragment thereof, numbered according to the Kabat EU numbering system;

p) introducing T366W and F405W mutations in the second antibody or fragment thereof, and introducing T394S and Y407A mutations in the first antibody or fragment thereof, numbered according to the Kabat EU numbering system;

q) introducing F405W and Y407A mutations in the second antibody or fragment thereof, and introducing T366W and T394S mutations in the first antibody or fragment thereof, numbered according to the Kabat EU numbering system; or r) introducing a T366W mutation in the second antibody or fragment thereof, and introducing T366S, L368A, and Y407V mutations in the first antibody or fragment thereof, numbered according to the Kabat EU numbering system.

259. The masked cytokine of any one of embodiments 238-251, wherein the amino acid sequence of the first antibody or fragment thereof and the amino acid sequence of the second antibody or fragment thereof are produced by:

a) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

b) introducing a Y407A mutation in the amino acid sequence of SEQ ID NO: 154 or 169, and introducing a T366W mutation in the amino acid sequence of SEQ ID NO: 154 or 169, respectively, numbered according to the Kabat EU numbering system;

c) introducing a F405A mutation in the amino acid sequence of SEQ ID NO: 154 or 169, and introducing a T394W mutation in the amino acid sequence of SEQ ID NO: 154 or 169, respectively, numbered according to the Kabat EU numbering system;

d) introducing a F405W mutation in the amino acid sequence of SEQ ID NO: 154 or 169, and introducing a T394S mutation in the amino acid sequence of SEQ ID NO: 154 or 169, respectively, numbered according to the Kabat EU numbering system;

e) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

f) introducing T366Y and F405A mutations in the amino acid sequence of SEQ ID NO: 154 or 169, and introducing T394W and Y407T mutations in the amino acid sequence of SEQ ID NO: 154 or 169, respectively, numbered according to the Kabat EU numbering system;

g) introducing T366W and F405W mutations in the amino acid sequence of SEQ ID NO: 154 or 169, and introducing T394S and Y407A mutations in the amino acid sequence of SEQ ID NO: 154 or 169, respectively, numbered according to the Kabat EU numbering system;

h) introducing F405W and Y407A mutations in the amino acid sequence of SEQ ID NO: 154 or 169, and introducing T366W and T394S mutations in the amino acid sequence of SEQ ID NO: 154 or 169, respectively, numbered according to the Kabat EU numbering system;

i) introducing a T366W mutation in the amino acid sequence of SEQ ID NO: 154 or 169, and introducing T366S, L368A, and Y407V mutations in the amino acid sequence of SEQ ID NO: 154 or 169, respectively, numbered according to the Kabat EU numbering system;

j) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

k) introducing a Y407A mutation in the amino acid sequence of SEQ ID NO: 154 or 169, and introducing a T366W mutation in the amino acid sequence of SEQ ID NO: 154 or 169, respectively, numbered according to the Kabat EU numbering system;

l) introducing a F405A mutation in the amino acid sequence of SEQ ID NO: 154 or 169, and introducing a T394W mutation in the amino acid sequence of SEQ ID NO: 154 or 169, respectively, numbered according to the Kabat EU numbering system;

m) introducing a F405W mutation in the amino acid sequence of SEQ ID NO: 154 or 169, and introducing a T394S mutation in the amino acid sequence of SEQ ID NO: 154 or 169, respectively, numbered according to the Kabat EU numbering system;

n) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

o) introducing T366Y and F405A mutations in the amino acid sequence of SEQ ID NO: 154 or 169, and introducing T394W and Y407T mutations in the amino acid sequence of SEQ ID NO: 154 or 169, respectively, numbered according to the Kabat EU numbering system;

p) introducing T366W and F405W mutations in the amino acid sequence of SEQ ID NO: 154 or 169, and introducing T394S and Y407A mutations in the amino acid sequence of SEQ ID NO: 154 or 169, respectively, numbered according to the Kabat EU numbering system;

q) introducing F405W and Y407A mutations in the amino acid sequence of SEQ ID NO: 154 or 169, and introducing T366W and T394S mutations in the amino acid sequence of SEQ ID NO: 154 or 169, respectively, numbered according to the Kabat EU numbering system; or r) introducing a T366W mutation in the amino acid sequence of SEQ ID NO: 154 or 169, and introducing T366S, L368A, and Y407V mutations in the amino acid sequence of SEQ ID NO: 154 or 169, respectively, numbered according to the Kabat EU numbering system.

260. The masked cytokine of any one of embodiments 238-251, wherein the modifications promoting the association of the first and the second half-life extension domain comprise:

a) introducing a K409E mutation in the first antibody or fragment thereof, and introducing a D399K mutation in the second antibody or fragment thereof, numbered according to the Kabat EU numbering system;

b) introducing a K409E mutation in the first antibody or fragment thereof, and introducing a D399R mutation in the second antibody or fragment thereof, numbered according to the Kabat EU numbering system;

c) introducing a K409D mutation in the first antibody or fragment thereof, and introducing a D399K mutation in the second antibody or fragment thereof, numbered according to the Kabat EU numbering system;

d) introducing a K409D mutation in the first antibody or fragment thereof, and introducing a D399R mutation in the second antibody or fragment thereof, numbered according to the Kabat EU numbering system;

e) introducing a K392E mutation in the first antibody or fragment thereof, and introducing a D399R mutation in the second antibody or fragment thereof, numbered according to the Kabat EU numbering system;

f) introducing a K392E mutation in the first antibody or fragment thereof, and introducing a D399K mutation in the second antibody or fragment thereof, numbered according to the Kabat EU numbering system;

g) introducing a K392D mutation in the first antibody or fragment thereof, and introducing a D399R mutation in the second antibody or fragment thereof, numbered according to the Kabat EU numbering system;

h) introducing a K392D mutation in the first antibody or fragment thereof, and introducing a D399K mutation in the second antibody or fragment thereof, numbered according to the Kabat EU numbering system;

i) introducing K409D and K360D mutations in the first antibody or fragment thereof, and introducing D399K and E356K mutations in the second antibody or fragment thereof, numbered according to the Kabat EU numbering system;

j) introducing K409D and K370D mutations in the first antibody or fragment thereof, and introducing D399K and E357K mutations in the second antibody or fragment thereof, numbered according to the Kabat EU numbering system;

k) introducing K409D and K392D mutations in the first antibody or fragment thereof, and introducing D399K, E356K, and E357K mutations in the second antibody or fragment thereof, numbered according to the Kabat EU numbering system;

l) introducing K409D and K392D mutations in the first antibody or fragment thereof, and introducing a D399K mutation in the second antibody or fragment thereof, numbered according to the Kabat EU numbering system;

m) introducing K409D and K392D mutations in the first antibody or fragment thereof, and introducing D399K and E356K mutations in the second antibody or fragment thereof, numbered according to the Kabat EU numbering system;

n) introducing K409D and K392D mutations in the first antibody or fragment thereof, and introducing D399K and E357K mutations in the second antibody or fragment thereof, numbered according to the Kabat EU numbering system;

o) introducing K409D and K370D mutations in the first antibody or fragment thereof, and introducing D399K and E357K mutations in the second antibody or fragment thereof, numbered according to the Kabat EU numbering system;

p) introducing a D399K mutation in the first antibody or fragment thereof, and introducing K409D and K360D mutations in the second antibody or fragment thereof, numbered according to the Kabat EU numbering system;

q) introducing K409D and K439D mutations in the first antibody or fragment thereof, and introducing D399K and E356K mutations in the second antibody or fragment thereof, numbered according to the Kabat EU numbering system;

r) introducing a K409E mutation in the second antibody or fragment thereof, and introducing a D399K mutation in the first antibody or fragment thereof, numbered according to the Kabat EU numbering system;

s) introducing a K409E mutation in the second antibody or fragment thereof, and introducing a D399R mutation in the first antibody or fragment thereof, numbered according to the Kabat EU numbering system;

t) introducing a K409D mutation in the second antibody or fragment thereof, and introducing a D399K mutation in the first antibody or fragment thereof, numbered according to the Kabat EU numbering system;

u) introducing a K409D mutation in the second antibody or fragment thereof, and introducing a D399R mutation in the first antibody or fragment thereof, numbered according to the Kabat EU numbering system;

v) introducing a K392E mutation in the second antibody or fragment thereof, and introducing a D399R mutation in the first antibody or fragment thereof, numbered according to the Kabat EU numbering system;

w) introducing a K392E mutation in the second antibody or fragment thereof, and introducing a D399K mutation in the first antibody or fragment thereof, numbered according to the Kabat EU numbering system;

x) introducing a K392D mutation in the second antibody or fragment thereof, and introducing a D399R mutation in the first antibody or fragment thereof, numbered according to the Kabat EU numbering system;

y) introducing a K392D mutation in the second antibody or fragment thereof, and introducing a D399K mutation in the first antibody or fragment thereof, numbered according to the Kabat EU numbering system;

z) introducing K409D and K360D mutations in the second antibody or fragment thereof, and introducing D399K and E356K mutations in the first antibody or fragment thereof, numbered according to the Kabat EU numbering system;

aa) introducing K409D and K370D mutations in the second antibody or fragment thereof, and introducing D399K and E357K mutations in the first antibody or fragment thereof, numbered according to the Kabat EU numbering system;

ab) introducing K409D and K392D mutations in the second antibody or fragment thereof, and introducing D399K, E356K, and E357K mutations in the first antibody or fragment thereof, numbered according to the Kabat EU numbering system;

ac) introducing K409D and K392D mutations in the second antibody or fragment thereof, and introducing a D399K mutation in the first antibody or fragment thereof, numbered according to the Kabat EU numbering system;

ad) introducing K409D and K392D mutations in the second antibody or fragment thereof, and introducing D399K and E356K mutations in the first antibody or fragment thereof, numbered according to the Kabat EU numbering system;

ae) introducing K409D and K392D mutations in the second antibody or fragment thereof, and introducing D399K and E357K mutations in the first antibody or fragment thereof, numbered according to the Kabat EU numbering system;

af) introducing K409D and K370D mutations in the second antibody or fragment thereof, and introducing D399K and E357K mutations in the first antibody or fragment thereof, numbered according to the Kabat EU numbering system;

ag) introducing a D399K mutation in the second antibody or fragment thereof, and introducing K409D and K360D mutations in the first antibody or fragment thereof, numbered according to the Kabat EU numbering system; or ah) introducing K409D and K439D mutations in the second antibody or fragment thereof, and introducing D399K and E356K mutations in the first antibody or fragment thereof, numbered according to the Kabat EU numbering system.

261. The masked cytokine of any one of embodiments 238-251, wherein the amino acid sequence of the first antibody or fragment thereof and the amino acid sequence of the second antibody or fragment thereof are produced by:

a) introducing a K409E mutation in the amino acid sequence of SEQ ID NO: 154 or 169, and introducing a D399K mutation in the amino acid sequence of SEQ ID NO: 154 or 169, respectively, numbered according to the Kabat EU numbering system;

b) introducing a K409E mutation in the amino acid sequence of SEQ ID NO: 154 or 169, and introducing a D399R mutation in the amino acid sequence of SEQ ID NO: 154 or 169, respectively, numbered according to the Kabat EU numbering system;

c) introducing a K409D mutation in the amino acid sequence of SEQ ID NO: 154 or 169, and introducing a D399K mutation in the amino acid sequence of SEQ ID NO: 154 or 169, respectively, numbered according to the Kabat EU numbering system;

d) introducing a K409D mutation in the amino acid sequence of SEQ ID NO: 154 or 169, and introducing a D399R mutation in the amino acid sequence of SEQ ID NO: 154 or 169, respectively, numbered according to the Kabat EU numbering system;

e) introducing a K392E mutation in the amino acid sequence of SEQ ID NO: 154 or 169, and introducing a D399R mutation in the amino acid sequence of SEQ ID NO: 154 or 169, respectively, numbered according to the Kabat EU numbering system;

f) introducing a K392E mutation in the amino acid sequence of SEQ ID NO: 154 or 169, and introducing a D399K mutation in the amino acid sequence of SEQ ID NO: 154 or 169, respectively, numbered according to the Kabat EU numbering system;

g) introducing a K392D mutation in the amino acid sequence of SEQ ID NO: 154 or 169, and introducing a D399R mutation in the amino acid sequence of SEQ ID NO: 154 or 169, respectively, numbered according to the Kabat EU numbering system;

h) introducing a K392D mutation in the amino acid sequence of SEQ ID NO: 154 or 169, and introducing a D399K mutation in the amino acid sequence of SEQ ID NO: 154 or 169, respectively, numbered according to the Kabat EU numbering system;

i) introducing K409D and K360D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

j) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

k) introducing K409D and K392D mutations in the amino acid sequence of SEQ ID NO: 154 or 169, and introducing D399K, E356K, and E357K mutations in the amino acid sequence of SEQ ID NO: 154 or 169, respectively, numbered according to the Kabat EU numbering system;

l) introducing K409D and K392D mutations in the amino acid sequence of SEQ ID NO: 154 or 169, and introducing a D399K mutation in the amino acid sequence of SEQ ID NO: 154 or 169, respectively, numbered according to the Kabat EU numbering system;

m) introducing K409D and K392D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

n) introducing K409D and K392D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

o) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

p) introducing a D399K mutation in the amino acid sequence of SEQ ID NO: 154 or 169, and introducing K409D and K360D mutations in the amino acid sequence of SEQ ID NO: 154 or 169, respectively, numbered according to the Kabat EU numbering system;

q) introducing K409D and K439D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

r) introducing a K409E mutation in the amino acid sequence of SEQ ID NO: 154 or 169, and introducing a D399K mutation in the amino acid sequence of SEQ ID NO: 154 or 169, respectively, numbered according to the Kabat EU numbering system;

s) introducing a K409E mutation in the amino acid sequence of SEQ ID NO: 154 or 169, and introducing a D399R mutation in the amino acid sequence of SEQ ID NO: 154 or 169, respectively, numbered according to the Kabat EU numbering system;

t) introducing a K409D mutation in the amino acid sequence of SEQ ID NO: 154 or 169, and introducing a D399K mutation in the amino acid sequence of SEQ ID NO: 154 or 169, respectively, numbered according to the Kabat EU numbering system;

u) introducing a K409D mutation in the amino acid sequence of SEQ ID NO: 154 or 169, and introducing a D399R mutation in the amino acid sequence of SEQ ID NO: 154 or 169, respectively, numbered according to the Kabat EU numbering system;

v) introducing a K392E mutation in the amino acid sequence of SEQ ID NO: 154 or 169, and introducing a D399R mutation in the amino acid sequence of SEQ ID NO: 154 or 169, respectively, numbered according to the Kabat EU numbering system;

w) introducing a K392E mutation in the amino acid sequence of SEQ ID NO: 154 or 169, and introducing a D399K mutation in the amino acid sequence of SEQ ID NO: 154 or 169, respectively, numbered according to the Kabat EU numbering system;

x) introducing a K392D mutation in the amino acid sequence of SEQ ID NO: 154 or 169, and introducing a D399R mutation in the amino acid sequence of SEQ ID NO: 154 or 169, respectively, numbered according to the Kabat EU numbering system;

y) introducing a K392D mutation in the amino acid sequence of SEQ ID NO: 154 or 169, and introducing a D399K mutation in the amino acid sequence of SEQ ID NO: 154 or 169, respectively, numbered according to the Kabat EU numbering system;

z) introducing K409D and K360D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

aa) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

ab) introducing K409D and K392D mutations in the amino acid sequence of SEQ ID NO: 154 or 169, and introducing D399K, E356K, and E357K mutations in the amino acid sequence of SEQ ID NO: 154 or 169, respectively, numbered according to the Kabat EU numbering system;

ac) introducing K409D and K392D mutations in the amino acid sequence of SEQ ID NO: 154 or 169, and introducing a D399K mutation in the amino acid sequence of SEQ ID NO: 154 or 169, respectively, numbered according to the Kabat EU numbering system;

ad) introducing K409D and K392D mutations in the amino acid sequence of SEQ ID NO: 154 or 169, and introducing D399K and E356K mutations in the amino acid sequence of SEQ ID NO: 154 or 169, numbered according to the Kabat EU numbering system;

ae) introducing K409D and K392D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

af) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

ag) introducing a D399K mutation in the amino acid sequence of SEQ ID NO: 154 or 169, and introducing K409D and K360D mutations in the amino acid sequence of SEQ ID NO: 154 or 169, respectively, numbered according to the Kabat EU numbering system; or ah) introducing K409D and K439D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system.

262. The masked cytokine of any one of embodiments 219-261, wherein the first linker comprises a first cleavable peptide; and/or wherein the second linker comprises a second cleavable peptide.

263. The masked cytokine of any one of embodiments 219-262, wherein the first linker comprises a first N-terminal spacer domain, and/or a first C-terminal spacer domain.

264. The masked cytokine of embodiment 263, wherein the first linker comprises:

a) the first N-terminal spacer domain, the first cleavable peptide, and the first C-terminal spacer domain;

b) the first N-terminal spacer domain and the first cleavable peptide;

c) the first N-terminal spacer domain and the first C-terminal spacer domain;

d) the first cleavable peptide and the first C-terminal spacer domain;

e) the first N-terminal spacer domain; or f) the first C-terminal spacer domain.

265. The masked cytokine of any one of embodiments 219-264, wherein the second linker comprises a second N-terminal spacer domain, and/or a second C-terminal spacer domain.

266. The masked cytokine of embodiment 265, wherein the second linker comprises:

a) the second N-terminal spacer domain, the second cleavable peptide, and the second C-terminal spacer domain;

b) the second N-terminal spacer domain and the second cleavable peptide;

c) the second N-terminal spacer domain and the second C-terminal spacer domain;

d) the second cleavable peptide and the second C-terminal spacer domain;

e) the second N-terminal spacer domain; or f) the second C-terminal spacer domain.

267. The masked cytokine of any one of embodiments 262-266, wherein the first cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555; and/or wherein the second cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555.

268. The masked cytokine of any one of embodiments 263-267, wherein the first N-terminal spacer domain comprises an amino acid sequence selected from the group consisting of SEQ ID NOs: 20-95, 235, 268, 269, 303-305, 323-338, 340, 341, 727, 794, and 799, and/or the first C-terminal spacer domain comprises an amino acid sequence selected from the group consisting of SEQ ID NOs: 20-95, 235, 268, 269, 303-305, 323-338, 340, 341, 727, 794, and 799.

269. The masked cytokine of any one of embodiments 262-266, wherein the first cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

270. The masked cytokine of embodiment 269, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

271. The masked cytokine of any one of embodiments 265-270, wherein the second N-terminal spacer domain comprises an amino acid sequence selected from the group consisting of SEQ ID NOs: 20-95, 235, 268, 269, 303-305, 323-338, 340, 341, 727, 794, and 799, and/or the second C-terminal spacer domain comprises an amino acid sequence selected from the group consisting of SEQ ID NOs: 20-95, 235, 268, 269, 303-305, 323-338, 340, 341, 727, 794, and 799.

272. The masked cytokine of any one of embodiments 262-271, wherein the second cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

273. The masked cytokine of embodiment 272, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

274. The masked cytokine of any one of embodiments 218-273, wherein the first linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812, and/or the second linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812.

275. The masked cytokine of any one of embodiments 219-274, wherein the third linker comprises a cleavable peptide.

276. The masked cytokine of any one of embodiments 219-275, wherein the third linker comprises a third N-terminal spacer domain, and/or a third C-terminal spacer domain.

277. The masked cytokine of embodiment 276, wherein the third linker comprises:
a) the third N-terminal spacer domain, the third cleavable peptide, and the third C-terminal spacer domain;
b) the third N-terminal spacer domain and the third cleavable peptide;
c) the third N-terminal spacer domain and the third C-terminal spacer domain;
d) the third cleavable peptide and the third C-terminal spacer domain;
e) the third N-terminal spacer domain; or
f) the third C-terminal spacer domain.

278. The masked cytokine of any one of embodiments 275-277, wherein the third cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555; and/or wherein the third cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555.

279. The masked cytokine of any one of embodiments 276-278, wherein the third N-terminal spacer domain comprises an amino acid sequence selected from the group consisting of SEQ ID NOs: 20-95, 235, 268, 269, 303-305, 323-338, 340, 341, 727, 794, and 799, and/or the third C-terminal spacer domain comprises an amino acid sequence selected from the group consisting of SEQ ID NOs: 20-95, 235, 268, 269, 303-305, 323-338, 340, 341, 727, 794, and 799.

280. The masked cytokine of any one of embodiments 275-279, wherein the third cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

281. The masked cytokine of embodiment 280, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

282. The masked cytokine of any one of embodiments 219-281, wherein the third linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812, and/or the third linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812.

283. The masked cytokine of any one of embodiments 254-282, wherein the fourth linker comprises a fourth N-terminal spacer domain, and/or a fourth C-terminal spacer domain.

284. The masked cytokine of embodiment 283, wherein the fourth N-terminal spacer domain comprises an amino acid sequence selected from the group consisting of SEQ ID NOs: 20-95, 235, 268, 269, 303-305, 323-338, 340, 341, 727, 794, and 799, and/or the fourth C-terminal spacer domain comprises an amino acid sequence selected from the group consisting of SEQ ID NOs: 20-95, 235, 268, 269, 303-305, 323-338, 340, 341, 727, 794, and 799.

285. The masked cytokine of any one of embodiments 262-284, wherein the first cleavable peptide, the second cleavable peptide, and/or the third cleavable peptide is a substrate for a protease that is co-localized in a region or a tissue expressing a cytokine receptor.

286. The masked cytokine of embodiment 285, wherein the cytokine receptor is an IL-2 cytokine receptor or an IL-15 cytokine receptor.

287. The masked cytokine of any one of embodiments 262-286, wherein the first cleavable peptide, the second cleavable peptide, and/or the third cleavable peptide is cleaved by one or more enzyme selected from the group consisting of: ABHD12, ADAM12, ABHD12B, ABHD13, ABHD17A, ADAM19, ADAM20, ADAM21, ADAM28, ADAM30, ADAM33, ADAM8, ABHD17A, ADAMDEC1, ADAMTS1, ADAMTS10, ADAMTS12, ADAMTS13, ADAMTS14, ADAMTS15, ADAMTS16, ADAMTS17, ADAMTS18, ADAMTS19, ADAMTS2, ADAMTS20, ADAMTS3, ADAMTS4, ABHD17B, ADAMTS5, ADAMTS6, ADAMTS7, ADAMTS8, ADAMTS9, ADAMTSL1, ADAMTSL2, ADAMTSL3, ABHD17C, ADAMTSL5, ASTL, BMP1, CELA1, CELA2A, CELA2B, CELA3A, CELA3B, ADAM10, ADAM15, ADAM17, ADAM9, ADAMTS4, CTSE, CTSF, ADAMTSL4, CMA1, CTRB1, CTRC, CTSO, CTR1, CTSA, CTSW, CTSB, CTSC, CTSD, ESP1, CTSG, CTSH, GZMA, GZMB, GZMH, CTSK, GZMM, CTSL, CTSS, CTSV, CTSZ, HTRA4, KLK10, KLK11, KLK13, KLK14, KLK2, KLK4, DPP4, KLK6, KLK7, KLKB1, ECE1, ECE2, ECEL1, MASP2, MEP1A, MEP1B, ELANE, FAP, GZMA, MMP11, GZMK, HGFAC, HPN, HTRA1, MMP11, MMP16, MMP17, MMP19, HTRA2, MMP20, MMP21, HTRA3, HTRA4, KEL, MMP23B, MMP24, MMP25, MMP26, MMP27, MMP28, KLK5, MMP3, MMP7, MMP8, MMP9, LGMN, LNPEP, MASP1, PAPPA, PAPPA2, PCSK1, NAPSA, PCSK5, PCSK6, MME, MMP1, MMP10, PLAT, PLAU, PLG, PRSS1, PRSS12, PRSS2, PRSS21, PRSS3, PRSS33, PRSS4, PRSS55, PRSS57, MMP12, PRSS8, PRSS9, PRTN3, MMP13, MMP14, ST14, TMPRSS10, TMPRSS11A, TMPRSS11D, TMPRSS11E, TMPRSS11F, TMPRSS12, TMPRSS13, MMP15, TMPRSS15, MMP2, TMPRSS2, TMPRSS3, TMPRSS4, TMPRSS5, TMPRSS6, TMPRSS7, TMPRSS9, NRDC, OVCH1, PAMR1, PCSK3, PHEX, TINAG, TPSAB1, TPSD1, and TPSG1.

288. The masked cytokine of any one of embodiments 218-287, wherein the first half-life extension domain and/or the second half-life extension domain is conjugated to an agent.

289. The masked cytokine of embodiment 288, wherein the agent is an inhibitor of tubulin polymerization, a DNA damaging agent, or a DNA synthesis inhibitor.

290. The masked cytokine of embodiment 289, wherein the agent is a maytansinoid, an auristatin, a pyrrolobenzodiazepine (PBD) dimer, a calicheamicin, a duocarmycin, a indo-linobenzodiazepine dimer or exatecan derivative Dxd.

291. The masked cytokine of embodiment 288, wherein the agent is an immune stimulant.

292. The masked cytokine of embodiment 291, wherein the immune stimulant is a stimulator of interferon genes (STING) agonist or a toll-like receptor (TLR) agonist.

293. The masked cytokine of embodiment 292, wherein the STING agonist is a cyclic dinucleotide (CDN).

294. The masked cytokine of embodiment 293, wherein the CDN is selected from the group consisting of cGAMP, c-di-AMP, c-di-GMP, cAIMP, c-di-IMP, 4-(2-chloro-6-fluorobenzyl)-N-(furan-2-ylmethyl)-3-oxo-3,4-dihydro-2H-benzo[b][1,4]thiazine-6-carboxamide.

295. The masked cytokine of embodiment 292, wherein the TLR agonist is an agonist of a TLR selected from the group consisting of TLR1, TLR2, TLR3, TLR4, TLR5, TLR6, TLR7, TLR8, TLR9, and TLR10.

296. A nucleic acid encoding the masked cytokine of any one of embodiments 1-295 and 320-409.

297. A vector comprising the nucleic acid of embodiment 296.

298. The vector of embodiment 297, which is an expression vector.

299. A host cell comprising the nucleic acid of embodiment 296.

300. A method of producing a masked cytokine comprising culturing the host cell of embodiment 299 under a condition that produces the masked cytokine.

301. The method of embodiment 300, further comprising recovering the masked cytokine produced by the host cell.

302. A masked cytokine produced by the method of embodiment 300 or embodiment 301.

303. A composition comprising the masked cytokine of any one of embodiments 1-295 and 320-409.

304. A composition comprising the masked cytokine of embodiment 302.

305. The composition of embodiment 303 or embodiment 304, further comprising an anti-inflammatory agent or an anti-cancer agent.

306. The composition of embodiment 305, wherein the anti-cancer agent is selected from the group consisting of a PD-1 inhibitor, an EGFR inhibitor, a HER2 inhibitor, a VEGFR inhibitor, a CTLA-4 inhibitor, a BTLA inhibitor, a B7H4 inhibitor, a B7H3 inhibitor, a CSFIR inhibitor, an HVEM inhibitor, a CD27 inhibitor, a KIR inhibitor, an NKG2A inhibitor, an NKG2D agonist, a TWEAK inhibitor, an ALK inhibitor, a CD52 targeting antibody, a CCR4 targeting antibody, a PD-L1 inhibitor, a KIT inhibitor, a PDGFR inhibitor, a BAFF inhibitor, an HDAC inhibitor, a VEGF ligand inhibitor, a CD19 targeting molecule, a FOLR1 targeting molecule, a DLL3 targeting molecule, a DKK1 targeting molecule, a MUC1 targeting molecule, a MUC16 targeting molecule, a PSMA targeting molecule, an MSLN targeting molecule, an NY-ES0-1 targeting molecule, a B7H3 targeting molecule, a B7H4 targeting molecule, a BCMA targeting molecule, a CD29 targeting molecule, a CD151targeting molecule, a CD123 targeting molecule, a CD33 targeting molecule, a CD37 targeting molecule, a CDH19 targeting molecule, a CEA targeting molecule, a Claudin 18.2 targeting molecule, a CLEC12A targeting molecule, an EGFRVIII targeting molecule, an EPCAM targeting molecule, an EPHA2 targeting molecule, an FCRH5 targeting molecule, an FLT3 targeting molecule, a GD2 targeting molecule, a glypican 3 targeting molecule, a gpA33 targeting molecule, a GPRC5D targeting molecule, an IL-23R targeting molecule, an IL-1RAP targeting molecule, a MCSP targeting molecule, a RON targeting molecule, a ROR1 targeting molecule, a STEAP2 targeting molecule, a TfR targeting molecule, a CD166 targeting molecule, a TPBG targeting molecule, a TROP2 targeting molecule, a proteasome inhibitor, an ABL inhibitor, a CD30 inhibitor, a FLT3 inhibitor, a MET inhibitor, a RET inhibitor, an IL-1β inhibitor, a MEK inhibitor, a ROS1 inhibitor, a BRAF inhibitor, a CD38 inhibitor, a RANKL inhibitor, a B4GALNT1 inhibitor, a SLAMF7 inhibitor, an IDH2 inhibitor, an mTOR inhibitor, a CD20 targeting antibody, a BTK inhibitor, a PI3K inhibitor, a FLT3 inhibitor, a PARP inhibitor, a CDK4 inhibitor, a CDK6 inhibitor, an FGFR inhibitor, a RAF inhibitor, a JAK1 inhibitor, a JAK2 inhibitor, a JAK3 inhibitor, an IL-6 inhibitor, a IL-17 inhibitor, a Smoothened inhibitor, an IL-6R inhibitor, a BCL2 inhibitor, a PTCH inhibitor, a PlGF inhibitor, a TGFB inhibitor, a CD28 agonist, a CD3 agonist, CD40 agonist, a GITR agonist, a OX40 agonist, a VISTA agonist, a CD137 agonist, a LAG3 inhibitor, a TIM3 inhibitor, a TIGIT inhibitor, and an IL-2R inhibitor.

307. The composition of embodiment 305, wherein the anti-inflammatory agent is a cyclooxygenase (COX) inhibitor or an NF-κB inhibitor.

308. The composition of embodiment 307, wherein the COX inhibitor is a COX-1 and/or COX-2 inhibitor.

309. The composition of embodiment 307 or embodiment 308, wherein the COX inhibitor is selected from the group consisting of SC-560, FR122047, P6, mofezolac, TFAP, flurbiprofen, ketoprofen, celecoxib, rofecoxib, meloxicam, piroxicam, deracoxib, parecoxib, valdecoxib, etoricoxib, a chromene derivative, a chroman derivative, N-(2-cyclohexyloxynitrophenyl) methane sulfonamide, parecoxib, lumiracoxib, RS 57067, T-614, BMS-347070, JTE-522, S-2474, SVT-2016, CT-3, ABT-963, SC-58125, nimesulide, flosulide, NS-398, L-745337, RWJ-63556, L-784512, darbufelone, CS-502, LAS-34475, LAS-34555, S-33516, diclofenac, mefenamic acid, SD-8381, ibuprofen, naproxen, ketorolac, indomethacin, aspirin, naproxen, tolmetin, piroxicam, and meclofenamate.

310. The composition of embodiment 307, wherein the NF-κB inhibitor is selected from the group consisting of an IKK complex inhibitor, an IκB degradation inhibitor, an NF-κB nuclear translocation inhibitor, a p65 acetylation inhibitor, an NF-κB DNA binding inhibitor, an NF-κB transactivation inhibitor, and a p53 induction inhibitor.

311. The composition of embodiment 307 or embodiment 308, wherein the NF-δB inhibitor is selected from the group consisting of TPCA-1, NF-κB Activation Inhibitor VI (BOT-64), BMS-345541, amlexanox, SC-514 (GK-01140), IMD-0354, IKK-16, BAY-11-7082, MG-115, MG-132, lactacystin, epoxomicin, parthenolide, carfilzomib, MLN-4924 (pevonedistat), JSH-23 rolipram, gallic acid, anacardic acid, GYY-4137, p-XSC, CV-3988, prostaglandin E2 (PGE2), LY-294002, wortmannin, mesalamine, quinacrine, and flavopiridol.

312. A pharmaceutical composition comprising the masked cytokine of any one of embodiments 1-295 and 320-409, and a pharmaceutically acceptable carrier.

313. A pharmaceutical composition comprising the masked cytokine of embodiment 302, and a pharmaceutically acceptable carrier.

314. A kit comprising the masked cytokine of any one of embodiments 1-295 and 320-409, or the composition of any one of embodiments 303-311, or the pharmaceutical composition of embodiment 312 or 313.

315. A method of treating or preventing a neoplastic disease in a subject, the method comprising administering to the subject an effective amount of the masked cytokine of any one of embodiments 1-295 and 320-409, or the composition of any one of embodiments 303-311.

316. The method of embodiment 315, wherein the neoplastic disease is a cancer.

317. The method of embodiment 316, wherein the cancer is leukemia, lymphoma, head and neck cancer, colorectal cancer, prostate cancer, pancreatic cancer, melanoma, breast cancer, neuroblastoma, lung cancer, ovarian cancer, osteosarcoma, bladder cancer, cervical cancer, liver cancer, kidney cancer, skin cancer or testicular cancer.

318. A method of treating or preventing an inflammatory or autoimmune disease in a subject, the method comprising administering to the subject an effective amount of the masked cytokine of any one of embodiments 1-295 and 320-409, or the composition of any one of embodiments 303-311.

319. The method of embodiment 318, wherein the inflammatory or autoimmune disease is selected from the group consisting of atherosclerosis, obesity, inflammatory bowel disease (IBD), rheumatoid arthritis, allergic encephalitis, psoriasis, atopic skin disease, osteoporosis, peritonitis, hepatitis, lupus, celiac disease, Sjogren's syndrome, polymyalgia rheumatica, multiple sclerosis (MS), ankylosing spondylitis, type 1 diabetes mellitus, alopecia areata, vasculitis, and temporal arteritis, graft versus host disease (GVHD), asthma, COPD, a paraneoplastic autoimmune disease, cartilage inflammation, juvenile arthritis, juvenile rheumatoid arthritis, pauciarticular juvenile rheumatoid arthritis, polyarticular juvenile rheumatoid arthritis, systemic onset juvenile rheumatoid arthritis, juvenile ankylosing spondylitis, juvenile enteropathic arthritis, juvenile reactive arthritis, juvenile Reiter's Syndrome, SEA Syndrome (Seronegativity, Enthesopathy, Arthropathy Syndrome), juvenile dermatomyositis, juvenile psoriatic arthritis, juvenile Scleroderma, juvenile systemic lupus erythematosus, juvenile vasculitis, pauciarticular rheumatoid arthritis, systemic onset rheumatoid arthritis, enteropathic arthritis, reactive arthritis, Reiter's Syndrome, dermatomyositis, psoriatic arthritis, Scleroderma, vasculitis, myolitis, polymyolitis, dermatomyolitis, polyarteritis nodosa, Wegener's granulomatosis, arteritis, ploymyalgia rheumatica, sarcoidosis, Sclerosis, primary biliary Sclerosis, Sclerosing cholangitis, psoriasis, plaque psoriasis, guttate psoriasis, inverse psoriasis, pustular psoriasis, erythrodermic psoriasis, dermatitis, atopic dermatitis, atherosclerosis, Still's disease, Systemic Lupus Erythematosus (SLE), myasthenia gravis, Crohn's disease, ulcerative colitis, celiac disease, rhinosinusitis, rhinosinusitis with polyps, eosinophilic esophogitis, eosinophilic bronchitis, Guillain-Barre disease, thyroiditis (e.g., Graves' disease), Addison's disease, Raynaud's phenomenon, autoimmune hepatitis, transplantation rejection, kidney damage, hepatitis C-induced vasculitis, and spontaneous loss of pregnancy.

320. A masked cytokine comprising:
a) a first half-life extension domain comprising the amino acid sequence of SEQ ID NO: 155, and a second half-life extension domain comprising the amino acid sequence of SEQ ID NO: 156;
b) a masking moiety comprising the amino acid sequence of SEQ ID NO: 261; and
c) a cytokine or functional fragment thereof comprising the amino acid sequence of SEQ ID NO: 3,
wherein the masking moiety is linked to the first half-life extension domain,
wherein the cytokine or functional fragment thereof is linked to the second half-life extension domain, and
wherein the first half-life extension domain and the second half-life extension domain contain modifications promoting the association of the first and the second half-life extension domain.

321. The masked cytokine of embodiment 320, wherein the masking moiety is linked to the first half-life extension domain via a first linker, and wherein the cytokine or functional fragment thereof is linked to the second half-life extension domain via a second linker.

322. The masked cytokine of embodiment 321, wherein the first linker comprises the amino acid sequence of SEQ ID NO: 28.

323. The masked cytokine of embodiment 321 or embodiment 322, wherein the second linker comprises a cleavable peptide comprising the amino acid sequence of SEQ ID NO: 264.

324. The masked cytokine of any one of embodiments 321-323, wherein the second linker comprises the amino acid sequence of SEQ ID NO: 811.

325. The masked cytokine of any one of embodiments 320-324, wherein the masked cytokine comprises the amino acid sequence of SEQ ID NO: 266.

326. The masked cytokine of any one of embodiments 320-325, wherein the masked cytokine comprises the amino acid sequence of SEQ ID NO: 267.

327. The masked cytokine of any one of embodiments 320-326, wherein the masked cytokine comprises the amino acid sequences of SEQ ID NOs: 266 and 267.

328. The masked cytokine of embodiment 1, wherein the masked cytokine comprises an amino acid sequence selected from the group consisting of SEQ ID NOs: 585-597, 602, 610-614, 627-636, 642, and 643.

329. The masked cytokine of embodiment 70, wherein the masked cytokine comprises an amino acid sequence selected from the group consisting of SEQ ID NOs: 567 and 598-601.

330. The masked cytokine of embodiment 149, wherein the masked cytokine comprises the amino acid sequences of: SEQ ID NOs: 562 and 563; or SEQ ID NOs: 608 and 603; or SEQ ID NOs: 604 and 603; or SEQ ID NOs: 605 and 603; or SEQ ID NOs: 606 and 603; or SEQ ID NOs: 615 and 617; or SEQ ID NOs: 266 and 267; or SEQ ID NOs: 618 and 620; or SEQ ID NOs: 621 and 623; or SEQ ID NOs: 624 and 626; or SEQ ID NOs: 608 and 267; or SEQ ID NOs: 663 and 664; or SEQ ID NOs: 665 and 666; or SEQ ID NOs: 667 and 267; or SEQ ID NOs: 669 and 267; or SEQ ID NOs: 670 and 671; or SEQ ID NOs: 670 and 671; or SEQ ID NOs: 672 and 267; or SEQ ID NOs: 673 and 267; or SEQ ID NOs: 674 and 267; or SEQ ID NOs: 675 and 267; or SEQ ID NOs: 676 and 267; or SEQ ID NOs: 677 and 267; or SEQ ID NOs: 678 and 267; or SEQ ID NOs: 679 and 267; or SEQ ID NOs: 680 and 267; or SEQ ID NOs: 681 and 267; or SEQ ID NOs: 682 and 267; or SEQ ID NOs: 683 and 267; or SEQ ID NOs: 684 and 267; or SEQ ID NOs: 685 and 267; or SEQ ID NOs: 686 and 267; SEQ ID NOs: 687 and 267; or SEQ ID NOs: 688 and 267; or SEQ ID NOs: 689 and 267; or SEQ ID NOs: 690 and 267;

or SEQ ID NOs: 692 and 267; or SEQ ID NOs: 693 and 267; or SEQ ID NOs: 694 and 267; or SEQ ID NOs: 695 and 267; or SEQ ID NOs: 696 and 267; or SEQ ID NOs: 697 and 267; or SEQ ID NOs: 698 and 267; or SEQ ID NOs: 699 and 267; or SEQ ID NOs: 700 and 267; or SEQ ID NOs: 701 and 267; or SEQ ID NOs: 702 and 267; or SEQ ID NOs: 703 and 267; or SEQ ID NOs: 704 and 267; or SEQ ID NOs: 705 and 267; or SEQ ID NOs: 706 and 267; or SEQ ID NOs: 707 and 267; or SEQ ID NOs: 708 and 267; or SEQ ID NOs: 709 and 267; or SEQ ID NOs: 710 and 267; or SEQ ID NOs: 711 and 267; or SEQ ID NOs: 712 and 667; or SEQ ID NOs: 713 and 267; or SEQ ID NOs: 714 and 267; or SEQ ID NOs: 716 and 699; or SEQ ID NOs: 717 and 267; or SEQ ID NOs: 718 and 267; or SEQ ID NOs: 719 and 267; or SEQ ID NOs: 720 and 267; or SEQ ID NOs: 722 and 267; or SEQ ID NOs: 723 and 267; or SEQ ID NOs: 720 and 267; or SEQ ID NOs: 728 and 267; or SEQ ID NOs: 729 and 267; or SEQ ID NOs: 730 and 267; or SEQ ID NOs: 731 and 267; or SEQ ID NOs: 732 and 267; or SEQ ID NOs: 733 and 267; or SEQ ID NOs: 734 and 267; or SEQ ID NOs: 735 and 267; or SEQ ID NOs: 736 and 267; or SEQ ID NOs: 737 and 267; or SEQ ID NOs: 738 and 267; or SEQ ID NOs: 739 and 267; or SEQ ID NOs: 740 and 267; or SEQ ID NOs: 741 and 267; or SEQ ID NOs: 742 and 267; or SEQ ID NOs: 743 and 267; or SEQ ID NOs: 744 and 267; or SEQ ID NOs: 745 and 267; or SEQ ID NOs: 746 and 267; or SEQ ID NOs: 674 and 828; or SEQ ID NOs: 674 and 829; or SEQ ID NOs: 726 and 830; or SEQ ID NOs: 726 and 829; or SEQ ID NOs: 747 and 671; or SEQ ID NOs: 715 and 267; or SEQ ID NOs: 715 and 671; or SEQ ID NOs: 748 and 671; or SEQ ID NOs: 749 and 671; or SEQ ID NOs: 750 and 671; or SEQ ID NOs: 751 and 671; or SEQ ID NOs: 752 and 671; or SEQ ID NOs: 753 and 671; or SEQ ID NOs: 754 and 671; or SEQ ID NOs: 758 and 671; or SEQ ID NOs: 759 and 671; or SEQ ID NOs: 760 and 671; or SEQ ID NOs: 761 and 671.

331. The masked cytokine of embodiment 218, wherein the masked cytokine comprises the amino acid sequences of: SEQ ID NOs: 755 and 616; or SEQ ID NOs: 756 and 616; or SEQ ID NOs: 757 and 616.

332. A masked cytokine comprising:
a) a first half-life extension domain and a second half-life extension domain;
b) a first masking moiety and a second masking moiety; and
c) a cytokine or functional fragment thereof,
wherein the first masking moiety is linked to the first half-life extension domain,
wherein the second masking moiety is linked to the first masking moiety,
wherein the cytokine or functional fragment thereof is linked to the second half-life extension domain, and
wherein the first half-life extension domain and the second half-life extension domain contain modifications promoting the association of the first and the second half-life extension domain.

333. The masked cytokine of embodiment 332, wherein:
a) the first masking moiety is linked to the first half-life extension domain via a first linker; and/or
b) the second masking moiety is linked to the first masking moiety via a second linker.

334. The masked cytokine of embodiment 332 or 333, wherein the cytokine or functional fragment thereof is linked to the second half-life extension domain via a third linker.

335. The masked cytokine of any one of embodiments 332-334, wherein the cytokine or functional fragment thereof is an IL-2 polypeptide or functional fragment thereof.

336. The masked cytokine of embodiment 335, wherein the IL-2 polypeptide or functional fragment thereof comprises an amino acid sequence selected from the group consisting of SEQ ID NOs: 1-8, 160, 243-251, 230, 243-251, 260, 775-792, and 813-822.

337. The masked cytokine of embodiment 335, wherein the IL-2 polypeptide or functional fragment thereof comprises an amino acid sequence produced by introducing one or more amino acid substitutions into the amino acid sequence of the IL-2 polypeptide or functional fragment thereof that reduces the affinity of the IL-2 polypeptide or functional fragment thereof for CD25 (IL-2Rα).

338. The masked cytokine of embodiment 337, wherein the amino acid sequence is produced by introducing one or more of the following amino acid substitutions into any one of SEQ ID NOs: 1-8, 160, 243-251, 260, 775-792, and 813-822: R38A, F42A, F42K, F42E, K43A, Y45A, Y45N, Y45R, E62A, E62R, E62S, and L72G.

339. The masked cytokine of embodiment 335, wherein the IL-2 polypeptide or functional fragment thereof comprises an amino acid sequence produced by introducing one or more amino acid substitutions into the amino acid sequence of the IL-2 polypeptide or functional fragment thereof that increases the affinity of the IL-2 polypeptide or functional fragment thereof for IL-2Rβ or IL-2Rγ.

340. The masked cytokine of embodiment 339, wherein the amino acid sequence is produced by introducing one or more of the following amino acid substitutions into any one of SEQ ID NOs: 1-8, 160, 243-251, 260, 775-792, and 813-822: H16I, L18C, D20A, D20L, D20F, N29L, L80F, R81D, L85V, I86V, and I92F.

341. The masked cytokine of embodiment 337 or embodiment 338, wherein the amino acid sequence is produced by further introducing one or more amino acid substitutions that increase the affinity of the IL-2 polypeptide or functional fragment thereof for IL-2Rβ or IL-2Rγ.

342. The masked cytokine of embodiment 341, wherein the one or more amino acid substitutions that increase the affinity of the IL-2 polypeptide or functional fragment thereof for IL-2Rβ or IL-2Rγ is selected from the group consisting of H16I, L18C, D20A, D20L, D20F, N29L, L80F, R81D, L85V, I86V, and I92F.

343. The masked cytokine of embodiment 335, wherein the IL-2 polypeptide or functional fragment thereof comprises an amino acid sequence produced by introducing one or more amino acid substitutions into the amino acid sequence of the IL-2 polypeptide or functional fragment thereof that stabilizes the IL-2 polypeptide or functional fragment thereof.

344. The masked cytokine of embodiment 343, wherein the amino acid sequence is produced by introducing one of the following amino acid substitutions into any one of SEQ ID NOs: 1-8, 160, 243-251, 260, 775-792, and 813-822: C125S, C125A, and C125G.

345. The masked cytokine of any one of embodiments 337-342, wherein the amino acid sequence is produced by further introducing one or more amino acid substitutions that stabilize the IL-2 polypeptide or functional fragment thereof.

346. The masked cytokine of embodiment 345, wherein the one or more amino acid substitutions that stabilize the IL-2 polypeptide or functional fragment thereof is the amino acid substitution C125S, C125A, or C125G.

347. The masked cytokine of any one of embodiments 335-346, wherein the first masking moiety comprises an amino acid sequence selected from the group consisting of SEQ ID NOs: 9, 10, 161-165, 187-218, 221-229, 231, 261, 826 and 827 and the second masking moiety comprises an amino acid sequence selected from the group consisting of SEQ ID NOs: 9, 10, 161-165, 187-218, 221-229, 231, 261, 826 and 827 and wherein the amino acid sequence of the first masking moiety and the second masking moiety are different.

348. The masked cytokine of any one of embodiments 335-347, wherein:
a) the first masking moiety comprises the amino acid sequence of SEQ ID NO: 9 or 231, and the second masking moiety comprises an amino acid sequence selected from the group consisting of SEQ ID NOs: 10, 161-165, 187-218, 221-226, 261, 826 and 827; or
b) the first masking moiety comprises an amino acid sequence selected from the group consisting of SEQ ID NOs: 10, 161-165, 187-218, 221-226, 261, 826 and 827, and the second masking moiety comprises the amino acid sequence of SEQ ID NO: 9 or 231.

349. The masked cytokine of any one of embodiments 332-334, wherein the cytokine or functional fragment thereof is an IL-15 polypeptide or functional fragment thereof.

350. The masked cytokine of embodiment 349, wherein the IL-15 polypeptide or functional fragment thereof comprises the amino acid sequence of SEQ ID NO: 167.

351. The masked cytokine of embodiment 349 or embodiment 350, wherein
a) the first masking moiety comprises an amino acid sequence selected from the group consisting of SEQ ID NOs: 232-234, and 823-825, and the second masking moiety comprises an amino acid sequence selected from the group consisting of SEQ ID NOs: 10, 161-165, 219-229, 261, 826 and 827;
b) the first masking moiety comprises an amino acid sequence selected from the group consisting of SEQ ID NOs: 10, 161-165, 219-229, 261, 826 and 827, and the second masking moiety comprises an amino acid sequence selected from the group consisting of SEQ ID NOs: 232-234, and 823-825;
c) the first masking moiety comprises an amino acid sequence produced by introducing one or more of the following amino acid substitutions into the amino acid sequence of any one of SEQ ID NOs: 232-234, and 823-825: R24A, R26A, K34A, S40A, L42A, and P67A, and the second masking moiety comprises an amino acid sequence selected from the group consisting of SEQ ID NOs: 10, 161-165, 219-229, 261, 826 and 827; or
d) the first masking moiety comprises an amino acid sequence selected from the group consisting of SEQ ID NOs: 10, 161-165, 219-229, 261, 826 and 827, and the second masking moiety comprises an amino acid sequence produced by introducing one or more of the following amino acid substitutions into the amino acid sequence of any one of SEQ ID NOs: 232-234, and 823-825: R24A, R26A, K34A, S40A, L42A, and P67A.

352. The masked cytokine of any one of embodiments 332-351, wherein the first half-life extension domain is a first antibody or fragment thereof, and the second half-life extension domain is a second antibody or fragment thereof.

353. The masked cytokine of embodiment 352, wherein:
a) the first antibody or fragment thereof comprises a first heavy chain polypeptide, and the second antibody or fragment thereof comprises a second light chain polypeptide; or
b) the first antibody or fragment thereof comprises a first light chain polypeptide, and the second antibody or fragment thereof comprises a second heavy chain polypeptide.

354. The masked cytokine of embodiment 353, wherein the first heavy chain polypeptide, or the second heavy chain polypeptide comprises one or more amino acid substitutions altering effector function.

355. The masked cytokine of embodiment 354, wherein the first heavy chain polypeptide or the second heavy chain polypeptide:
a) is an IgG1 isotype and comprises the amino substitution(s):
i) N297A, N297G, or N297Q;
ii) L234A and L235A;
iii) C220S, C226S, C229S, and P238S;
iv) C226S, C229S, E233P, L234V, and L235A;
v) L234F, L235E, and P331S;
vi) S267E and L328F;
vii) D265A;
viii) L234A, L235A, and P329G;
b) is an IgG2 isotype and comprises the amino acid substitution(s):
i) V234A and G237A;
ii) H268Q, V309L, A330S, and A331S; or
iii) V234A, G237A, P238S, H268A, V309L, A330S, and P331S; or
e) is an IgG4 isotype and comprises the amino acid substitution(s):
i) L235A, G237A, and E318A;
ii) S228P, L234A, and L235A;
iii) H268Q, V309L, A330S, and P331S; or
iv) S228P and L235A, numbered according to the Kabat EU numbering system.

356. The masked cytokine of embodiment 353, wherein the first heavy chain polypeptide or the second heavy chain polypeptide comprises one or more amino acid substitutions enhancing effector function.

357. The masked cytokine of embodiment 356, wherein the first heavy chain polypeptide or the second heavy chain polypeptide is an IgG1 heavy chain polypeptide and comprises the amino acid substitution(s):
a) S298A, E333A, and K334A;
b) S239D and I332E;
c) S239D, A330L, and I332E;
d) P247I and A339D or A339Q;
e) D280H and K290S;
f) D280H, K290S, and either S298D or S298V;
g) F243L, R292P, and Y300L;
h) F243L, R292P, Y300L, and P396L;
i) F243L, R292P, Y300L, V305I, and P396L;
j) G236A, S239D, and I332E;
k) K326A and E333A;
l) K326W and E333S;
m) K290E, S298G, and T299A;
n) K290E, S298G, T299A, and K326E;
o) K290N, S298G, and T299A;
p) K290N, S298G, T299A, and K326E;
q) K334V;
r) L235S, S239D, and K334V;
s) K334V and Q331M, S239D, F243V, E294L, or S298T;
t) E233L, Q311M, and K334V;
u) L234I, Q311M, and K334V;
v) K334V and S298T, A330M, or A330F;
w) K334V, Q311M, and either A330M or A330F;
x) K334V, S298T, and either A330M or A330F;
y) K334V, S239D, and either A330M or S298T;
z) L234Y, Y296W, and K290Y, F243V, or E294L;
aa) Y296W and either L234Y or K290Y;
ab) S239D, A330S, and I332E,
ac) V264I;

ad) F243L and V264I;
ae) L328M;
af) I332E;
ag) L328M and I332E;
ah) V264I and I332E;
ai) S239E and I332E;
aj) S239Q and I332E;
ak) S239E;
al) A330Y;
am) I332D;
an) L328I and I332E;
ao) L328Q and I332E;
ap) V264T;
aq) V240I;
ar) V266I;
as) S239D;
at) S239D and I332D;
au) S239D and I332N;
av) S239D and I332Q;
aw) S239E and I332D;
ax) S239E and I332N;
ay) S239E and I332Q;
az) S239N and I332D;
ba) S239N and I332E;
bb) S239Q and I332D;
bc) A330Y and I332E;
bd) V264I, A330Y, and I332E;
be) A330L and I332E;
bf) V264I, A330L, and I332E;
bg) L234E, L234Y, or L234I;
bh) L235D, L235S, L235Y, or L235I;
bi) S239T;
bj) V240M;
bk) V264Y;
bl) A330I;
bm) N325T;
bn) I332E and L328D, L328V, L328T, or L328I;
bo) V264I, I332E, and either S239E or S239Q;
bp) S239E, V264I, A330Y, and I332E;
bq) A330Y, I332E, and either S239D or S239N;
br) A330L, I332E, and either S239D or S239N;
bs) V264I, S298A, and I332E;
bt) S298A, I332E, and either S239D or S239N;
bu) S239D, V264I, and I332E;
by) S239D, V264I, S298A, and I332E;
bw) S239D, V264I, A330L, and I332E;
bx) S239D, I332E, and A330I;
by) P230A;
bz) P230A, E233D, and I332E;
ca) E272Y;
cb) K274T, K274E, K274R, K274L, or K274Y;
cd) F275W;
ce) N276L;
cf) Y278T;
cg) V302I;
ch) E318R;
ci) S324D, S324I or S324V;
cj) K326I or K326T;
ck) T335D, T335R, or T335Y;
cl) V240I and V266I;
cm) S239D, A330Y, I332E, and L234I;
cn) S239D, A330Y, I332E, and L235D;
co) S239D, A330Y, I332E, and V240I;
cp) S239D, A330Y, I332E, and V264T; or
cq) S239D, A330Y, I332E, and either K326E or K326T,
numbered according to the Kabat EU numbering system.

358. The masked cytokine of embodiment 353, wherein the first heavy chain polypeptide comprises an amino acid sequence selected from the group consisting of SEQ ID NOs: 158, 168, and 169, and the second heavy chain polypeptide comprises an amino acid sequence selected from the group consisting of SEQ ID NOs: 158, 168, and 169.

359. The masked cytokine of embodiment 353, wherein the first light chain polypeptide comprises the amino acid sequence of SEQ ID NO: 157 or 170, and the second light chain polypeptide comprises the amino acid sequence of SEQ ID NO: 157 or 170.

360. The masked cytokine of embodiment 352, wherein the first antibody or fragment thereof is a first Fragment crystallizable domain (Fc domain) or fragment thereof, and the second antibody or fragment thereof is a second Fc domain or fragment thereof.

361. The masked cytokine of embodiment 360, wherein the first Fc domain or fragment thereof, and/or the second Fc domain or fragment thereof comprises one or more amino acid substitutions altering effector function.

362. The masked cytokine of embodiment 361, wherein the first Fc domain or fragment thereof and/or the second Fc domain or fragment thereof:
  a) is an IgG1 Fc domain or fragment thereof and comprises the amino substitution(s):
    i) N297A, N297G, or N297Q;
    ii) L234A and L235A;
    iii) C220S, C226S, C229S, and P238S;
    iv) C226S, C229S, E233P, L234V, and L235A;
    v) L234F, L235E, and P331S;
    vi) S267E and L328F;
    vii) D265A;
    viii) L234A, L235A, and P329G;
  b) is an IgG2 Fc domain or fragment thereof and comprises the amino acid substitution(s):
    i) V234A and G237A;
    ii) H268Q, V309L, A330S, and A331S; or
    iii) V234A, G237A, P238S, H268A, V309L, A330S, and P331S; or
  e) is an IgG4 Fc domain or fragment thereof and comprises the amino acid substitution(s):
    i) L235A, G237A, and E318A;
    ii) S228P, L234A, and L235A;
    iii) H268Q, V309L, A330S, and P331S; or
    iv) S228P and L235A, numbered according to the Kabat EU numbering system.

363. The masked cytokine of embodiment 361, wherein the first Fc domain or fragment thereof and/or the second Fc domain or fragment thereof comprises one or more amino acid substitutions enhancing effector function.

364. The masked cytokine of embodiment 363, wherein the first Fc domain or fragment thereof and/or the second Fc domain or fragment thereof is an IgG1 Fc domain or fragment thereof and comprises the amino acid substitution(s):
  a) S298A, E333A, and K334A;
  b) S239D and I332E;
  c) S239D, A330L, and I332E;
  d) P247I and A339D or A339Q;
  e) D280H and K290S;
  f) D280H, K290S, and either S298D or S298V;
  g) F243L, R292P, and Y300L;
  h) F243L, R292P, Y300L, and P396L;
  i) F243L, R292P, Y300L, V305I, and P396L;
  j) G236A, S239D, and I332E;
  k) K326A and E333A;

l) K326W and E333S;
m) K290E, S298G, and T299A;
n) K290E, S298G, T299A, and K326E;
o) K290N, S298G, and T299A;
p) K290N, S298G, T299A, and K326E;
q) K334V;
r) L235S, S239D, and K334V;
s) K334V and Q331M, S239D, F243V, E294L, or S298T;
t) E233L, Q311M, and K334V;
u) L234I, Q311M, and K334V;
v) K334V and S298T, A330M, or A330F;
w) K334V, Q311M, and either A330M or A330F;
x) K334V, S298T, and either A330M or A330F;
y) K334V, S239D, and either A330M or S298T;
z) L234Y, Y296W, and K290Y, F243V, or E294L;
aa) Y296W and either L234Y or K290Y;
ab) S239D, A330S, and I332E,
ac) V264I;
ad) F243L and V264I;
ae) L328M;
af) I332E;
ag) L328M and I332E;
ah) V264I and I332E;
ai) S239E and I332E;
aj) S239Q and I332E;
ak) S239E;
al) A330Y;
am) I332D;
an) L328I and I332E;
ao) L328Q and I332E;
ap) V264T;
aq) V240I;
ar) V266I;
as) S239D;
at) S239D and I332D;
au) S239D and I332N;
av) S239D and I332Q;
aw) S239E and I332D;
ax) S239E and I332N;
ay) S239E and I332Q;
az) S239N and I332D;
ba) S239N and I332E;
bb) S239Q and I332D;
bc) A330Y and I332E;
bd) V264I, A330Y, and I332E;
be) A330L and I332E;
bf) V264I, A330L, and I332E;
bg) L234E, L234Y, or L234I;
bh) L235D, L235S, L235Y, or L235I;
bi) S239T;
bj) V240M;
bk) V264Y;
bl) A330I;
bm) N325T;
bn) I332E and L328D, L328V, L328T, or L328I;
bo) V264I, I332E, and either S239E or S239Q;
bp) S239E, V264I, A330Y, and I332E;
bq) A330Y, I332E, and either S239D or S239N;
br) A330L, I332E, and either S239D or S239N;
bs) V264I, S298A, and I332E;
bt) S298A, I332E, and either S239D or S239N;
bu) S239D, V264I, and I332E;
by) S239D, V264I, S298A, and I332E;
bw) S239D, V264I, A330L, and I332E;
bx) S239D, I332E, and A330I;
by) P230A;
bz) P230A, E233D, and I332E;
ca) E272Y;
cb) K274T, K274E, K274R, K274L, or K274Y;
cd) F275W;
ce) N276L;
cf) Y278T;
cg) V302I;
ch) E318R;
ci) S324D, S324I or S324V;
cj) K326I or K326T;
ck) T335D, T335R, or T335Y;
cl) V240I and V266I;
cm) S239D, A330Y, I332E, and L234I;
cn) S239D, A330Y, I332E, and L235D;
co) S239D, A330Y, I332E, and V240I;
cp) S239D, A330Y, I332E, and V264T; or
cq) S239D, A330Y, I332E, and either K326E or K326T, numbered according to the Kabat EU numbering system.

365. The masked cytokine of embodiment 360, wherein:

a) the first Fc domain or fragment thereof comprises the amino acid sequence of SEQ ID NO: 155, and the second Fc domain or fragment thereof comprises the amino acid sequence of SEQ ID NO: 156;

b) the first Fc domain or fragment thereof comprises the amino acid sequence of SEQ ID NO: 156, and the second Fc domain or fragment thereof comprises the amino acid sequence of SEQ ID NO: 155;

c) the first Fc domain or fragment thereof comprises the amino acid sequence of SEQ ID NO: 154, and the second Fc domain or fragment thereof comprises the amino acid sequence of SEQ ID NO: 154;

d) the first Fc domain or fragment thereof comprises the amino acid sequence of SEQ ID NO: 265, and the second Fc domain or fragment thereof comprises the amino acid sequence of SEQ ID NO: 156;

e) the first Fc domain or fragment thereof comprises the amino acid sequence of SEQ ID NO: 156, and the second Fc domain or fragment thereof comprises the amino acid sequence of SEQ ID NO: 265;

f) the first Fc domain or fragment thereof comprises the amino acid sequence of SEQ ID NO: 155, and the second Fc domain or fragment thereof comprises the amino acid sequence of SEQ ID NO: 616;

g) the first Fc domain or fragment thereof comprises the amino acid sequence of SEQ ID NO: 616, and the second Fc domain or fragment thereof comprises the amino acid sequence of SEQ ID NO: 155;

h) the first Fc domain or fragment thereof comprises the amino acid sequence of SEQ ID NO: 157, and the second Fc domain or fragment thereof comprises the amino acid sequence of SEQ ID NO: 158;

i) the first Fc domain or fragment thereof comprises the amino acid sequence of SEQ ID NO: 158, and the second Fc domain or fragment thereof comprises the amino acid sequence of SEQ ID NO: 157;

j) the first Fc domain or fragment thereof comprises the amino acid sequence of SEQ ID NO: 796, and the second Fc domain or fragment thereof comprises the amino acid sequence of SEQ ID NO: 774;

k) the first Fc domain or fragment thereof comprises the amino acid sequence of SEQ ID NO: 774, and the second Fc domain or fragment thereof comprises the amino acid sequence of SEQ ID NO: 796;

l) the first Fc domain or fragment thereof comprises the amino acid sequence of SEQ ID NO: 721, and the second Fc domain or fragment thereof comprises the amino acid sequence of SEQ ID NO: 619;

m) the first Fc domain or fragment thereof comprises the amino acid sequence of SEQ ID NO: 619, and the second Fc domain or fragment thereof comprises the amino acid sequence of SEQ ID NO: 721;

n) the first Fc domain or fragment thereof comprises the amino acid sequence of SEQ ID NO: 721, and the second Fc domain or fragment thereof comprises the amino acid sequence of SEQ ID NO: 772;

o) the first Fc domain or fragment thereof comprises the amino acid sequence of SEQ ID NO: 772, and the second Fc domain or fragment thereof comprises the amino acid sequence of SEQ ID NO: 721;

p) the first Fc domain or fragment thereof comprises the amino acid sequence of SEQ ID NO: 793, and the second Fc domain or fragment thereof comprises the amino acid sequence of SEQ ID NO: 622;

q) the first Fc domain or fragment thereof comprises the amino acid sequence of SEQ ID NO: 622, and the second Fc domain or fragment thereof comprises the amino acid sequence of SEQ ID NO: 793;

r) the first Fc domain or fragment thereof comprises the amino acid sequence of SEQ ID NO: 793, and the second Fc domain or fragment thereof comprises the amino acid sequence of SEQ ID NO: 773;

s) the first Fc domain or fragment thereof comprises the amino acid sequence of SEQ ID NO: 773, and the second Fc domain or fragment thereof comprises the amino acid sequence of SEQ ID NO: 793;

t) the first Fc domain or fragment thereof comprises the amino acid sequence of SEQ ID NO: 796, and the second Fc domain or fragment thereof comprises the amino acid sequence of SEQ ID NO: 625;

u) the first Fc domain or fragment thereof comprises the amino acid sequence of SEQ ID NO: 625, and the second Fc domain or fragment thereof comprises the amino acid sequence of SEQ ID NO: 796;

v) the first Fc domain or fragment thereof comprises the amino acid sequence of SEQ ID NO: 156, and the second Fc domain or fragment thereof comprises the amino acid sequence of SEQ ID NO: 156;

w) the first Fc domain or fragment thereof comprises the amino acid sequence of SEQ ID NO: 796, and the second Fc domain or fragment thereof comprises the amino acid sequence of SEQ ID NO: 625; or x) the first Fc domain or fragment thereof comprises the amino acid sequence of SEQ ID NO: 625, and the second Fc domain or fragment thereof comprises the amino acid sequence of SEQ ID NO: 796.

366. The masked cytokine of any one of embodiments 332-351, wherein the first half-life extension domain is a first scFv or fragment thereof, and the second half-life extension domain is a second scFv or fragment thereof.

367. The masked cytokine of any one of embodiments 332-351, wherein the first half-life extension domain is a first Fc domain or fragment thereof, and the second half-life extension domain is a second Fc domain or fragment thereof, and wherein the first Fc domain or fragment thereof is linked to the second Fc domain or fragment thereof.

368. The masked cytokine of embodiment 367, wherein the first Fc domain or fragment thereof is linked to the second Fc domain or fragment thereof via a fourth linker.

369. The masked cytokine of any one of embodiments 232-351, wherein:

a) the first half-life extension domain is an scFv or fragment thereof, and the second half-life extension domain is an antibody or fragment thereof; or a) the first half-life extension domain is an antibody or fragment thereof, and the second half-life extension domain is an scFv or fragment thereof.

370. The masked cytokine of any one of embodiments 352-365, wherein the modifications promoting the association of the first and the second half-life extension domain comprise:

a) introducing S354C and T366W mutations in the first antibody or fragment thereof, and introducing Y349C, T366S, L368A, and Y407V mutations in the second antibody or fragment thereof, numbered according to the Kabat EU numbering system;

b) introducing S354C and T366W mutations in the second antibody or fragment thereof, and introducing Y349C, T366S, L368A, and Y407V mutations in the first antibody or fragment thereof, numbered according to the Kabat EU numbering system;

c) introducing K392D and K409D mutations in the first antibody or fragment thereof, and introducing D399K and E356K mutations in the second antibody or fragment thereof, numbered according to the Kabat EU numbering system;

d) introducing K392D and K409D mutations in the second antibody or fragment thereof, and introducing D399K and E356K mutations in the first antibody or fragment thereof, numbered according to the Kabat EU numbering system;

e) introducing S364H and F405A mutations in the first antibody or fragment thereof, and introducing Y349T and T394F mutations in the second antibody or fragment thereof, numbered according to the Kabat EU numbering system; or f) introducing S364H and F405A mutations in the second antibody or fragment thereof, and introducing Y349T and T394F mutations in the first antibody or fragment thereof, numbered according to the Kabat EU numbering system.

371. The masked cytokine of any one of embodiments 352-365, wherein the amino acid sequence of the first antibody or fragment thereof and the amino acid sequence of the second antibody or fragment thereof are produced by:

a) introducing S354C and T366W mutations in the amino acid sequence of SEQ ID NO: 154 or 169, and introducing Y349C, T366S, L368A, and Y407V mutations in the amino acid sequence of SEQ ID NO: 154 or 169, respectively, numbered according to the Kabat EU numbering system;

b) introducing S354C and T366W mutations in the amino acid sequence of SEQ ID NO: 154 or 169, and introducing Y349C, T366S, L368A, and Y407V mutations in the amino acid sequence of SEQ ID NO: 154 or 169, respectively, numbered according to the Kabat EU numbering system;

c) introducing K392D and K409D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

d) introducing K392D and K409D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

e) introducing S364H and F405A mutations in the amino acid sequence of SEQ ID NO: 154 or 169, and introducing Y349T and T394F mutations in the amino acid sequence of SEQ ID NO: 154 or 169, respectively, numbered according to the Kabat EU numbering system; or f) introducing S364H and F405A mutations in the amino acid sequence of SEQ ID NO: 154 or 169, and introducing Y349T and T394F mutations in the amino acid sequence of SEQ ID NO: 154 or 169, respectively, numbered according to the Kabat EU numbering system.

372. The masked cytokine of any one of embodiments 352-365, wherein the modifications promoting the association of the first and the second half-life extension domain comprise:

a) introducing a Y407T mutation in the first antibody or fragment thereof, and introducing a T366Y mutation in the second antibody or fragment thereof, numbered according to the Kabat EU numbering system;

b) introducing a Y407A mutation in the first antibody or fragment thereof, and introducing a T366W mutation in the second antibody or fragment thereof, numbered according to the Kabat EU numbering system;

c) introducing a F405A mutation in the first antibody or fragment thereof, and introducing a T394W mutation in the second antibody or fragment thereof, numbered according to the Kabat EU numbering system;

d) introducing a F405W mutation in the first antibody or fragment thereof, and introducing a T394S mutation in the second antibody or fragment thereof, numbered according to the Kabat EU numbering system;

e) introducing a Y407T mutation in the first antibody or fragment thereof, and introducing a T366Y mutation in the second antibody or fragment thereof, numbered according to the Kabat EU numbering system;

f) introducing T366Y and F405A mutations in the first antibody or fragment thereof, and introducing T394W and Y407T mutations in the second antibody or fragment thereof, numbered according to the Kabat EU numbering system;

g) introducing T366W and F405W mutations in the first antibody or fragment thereof, and introducing T394S and Y407A mutations in the second antibody or fragment thereof, numbered according to the Kabat EU numbering system;

h) introducing F405W and Y407A mutations in the first antibody or fragment thereof, and introducing T366W and T394S mutations in the second antibody or fragment thereof, numbered according to the Kabat EU numbering system;

i) introducing a T366W mutation in the first antibody or fragment thereof, and introducing T366S, L368A, and Y407V mutations in the second antibody or fragment thereof, numbered according to the Kabat EU numbering system;

j) introducing a Y407T mutation in the second antibody or fragment thereof, and introducing a T366Y mutation in the first antibody or fragment thereof, numbered according to the Kabat EU numbering system;

k) introducing a Y407A mutation in the second antibody or fragment thereof, and introducing a T366W mutation in the first antibody or fragment thereof, numbered according to the Kabat EU numbering system;

l) introducing a F405A mutation in the second antibody or fragment thereof, and introducing a T394W mutation in the first antibody or fragment thereof, numbered according to the Kabat EU numbering system;

m) introducing a F405W mutation in the second antibody or fragment thereof, and introducing a T394S mutation in the first antibody or fragment thereof, numbered according to the Kabat EU numbering system;

n) introducing a Y407T mutation in the second antibody or fragment thereof, and introducing a T366Y mutation in the first antibody or fragment thereof, numbered according to the Kabat EU numbering system;

o) introducing T366Y and F405A mutations in the second antibody or fragment thereof, and introducing T394W and Y407T mutations in the first antibody or fragment thereof, numbered according to the Kabat EU numbering system;

p) introducing T366W and F405W mutations in the second antibody or fragment thereof, and introducing T394S and Y407A mutations in the first antibody or fragment thereof, numbered according to the Kabat EU numbering system;

q) introducing F405W and Y407A mutations in the second antibody or fragment thereof, and introducing T366W and T394S mutations in the first antibody or fragment thereof, numbered according to the Kabat EU numbering system; or r) introducing a T366W mutation in the second antibody or fragment thereof, and introducing T366S, L368A, and Y407V mutations in the first antibody or fragment thereof, numbered according to the Kabat EU numbering system.

373. The masked cytokine of any one of embodiments 352-365, wherein the amino acid sequence of the first antibody or fragment thereof and the amino acid sequence of the second antibody or fragment thereof are produced by:

a) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

b) introducing a Y407A mutation in the amino acid sequence of SEQ ID NO: 154 or 169, and introducing a T366W mutation in the amino acid sequence of SEQ ID NO: 154 or 169, respectively, numbered according to the Kabat EU numbering system;

c) introducing a F405A mutation in the amino acid sequence of SEQ ID NO: 154 or 169, and introducing a T394W mutation in the amino acid sequence of SEQ ID NO: 154 or 169, respectively, numbered according to the Kabat EU numbering system;

d) introducing a F405W mutation in the amino acid sequence of SEQ ID NO: 154 or 169, and introducing a T394S mutation in the amino acid sequence of SEQ ID NO: 154 or 169, respectively, numbered according to the Kabat EU numbering system;

e) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

f) introducing T366Y and F405A mutations in the amino acid sequence of SEQ ID NO: 154 or 169, and introducing T394W and Y407T mutations in the amino acid sequence of SEQ ID NO: 154 or 169, respectively, numbered according to the Kabat EU numbering system;

g) introducing T366W and F405W mutations in the amino acid sequence of SEQ ID NO: 154 or 169, and introducing T394S and Y407A mutations in the amino acid sequence of SEQ ID NO: 154 or 169, respectively, numbered according to the Kabat EU numbering system;

h) introducing F405W and Y407A mutations in the amino acid sequence of SEQ ID NO: 154 or 169, and introducing T366W and T394S mutations in the amino acid sequence of SEQ ID NO: 154 or 169, respectively, numbered according to the Kabat EU numbering system;

i) introducing a T366W mutation in the amino acid sequence of SEQ ID NO: 154 or 169, and introducing T366S, L368A, and Y407V mutations in the amino acid sequence of SEQ ID NO: 154 or 169, respectively, numbered according to the Kabat EU numbering system;

j) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

k) introducing a Y407A mutation in the amino acid sequence of SEQ ID NO: 154 or 169, and introducing a T366W mutation in the amino acid sequence of SEQ ID NO: 154 or 169, respectively, numbered according to the Kabat EU numbering system;

l) introducing a F405A mutation in the amino acid sequence of SEQ ID NO: 154 or 169, and introducing a T394W mutation in the amino acid sequence of SEQ ID NO: 154 or 169, respectively, numbered according to the Kabat EU numbering system;

m) introducing a F405W mutation in the amino acid sequence of SEQ ID NO: 154 or 169, and introducing a T394S mutation in the amino acid sequence of SEQ ID NO: 154 or 169, respectively, numbered according to the Kabat EU numbering system;

n) introducing a Y407T mutation in the amino acid sequence of SEQ ID NO: 154 or 169, and introducing a T366Y mutation in the amino acid sequence of SEQ ID NO: 154 or 169, respectively, numbered according to the Kabat EU numbering system;

o) introducing T366Y and F405A mutations in the amino acid sequence of SEQ ID NO: 154 or 169, and introducing T394W and Y407T mutations in the amino acid sequence of SEQ ID NO: 154 or 169, respectively, numbered according to the Kabat EU numbering system;

p) introducing T366W and F405W mutations in the amino acid sequence of SEQ ID NO: 154 or 169, and introducing T394S and Y407A mutations in the amino acid sequence of SEQ ID NO: 154 or 169, respectively, numbered according to the Kabat EU numbering system;

q) introducing F405W and Y407A mutations in the amino acid sequence of SEQ ID NO: 154 or 169, and introducing T366W and T394S mutations in the amino acid sequence of SEQ ID NO: 154 or 169, respectively, numbered according to the Kabat EU numbering system; or r) introducing a T366W mutation in the amino acid sequence of SEQ ID NO: 154 or 169, and introducing T366S, L368A, and Y407V mutations in the amino acid sequence of SEQ ID NO: 154 or 169, respectively, numbered according to the Kabat EU numbering system.

374. The masked cytokine of any one of embodiments 352-365, wherein the modifications promoting the association of the first and the second half-life extension domain comprise:

a) introducing a K409E mutation in the first antibody or fragment thereof, and introducing a D399K mutation in the second antibody or fragment thereof, numbered according to the Kabat EU numbering system;

b) introducing a K409E mutation in the first antibody or fragment thereof, and introducing a D399R mutation in the second antibody or fragment thereof, numbered according to the Kabat EU numbering system;

c) introducing a K409D mutation in the first antibody or fragment thereof, and introducing a D399K mutation in the second antibody or fragment thereof, numbered according to the Kabat EU numbering system;

d) introducing a K409D mutation in the first antibody or fragment thereof, and introducing a D399R mutation in the second antibody or fragment thereof, numbered according to the Kabat EU numbering system;

e) introducing a K392E mutation in the first antibody or fragment thereof, and introducing a D399R mutation in the second antibody or fragment thereof, numbered according to the Kabat EU numbering system;

f) introducing a K392E mutation in the first antibody or fragment thereof, and introducing a D399K mutation in the second antibody or fragment thereof, numbered according to the Kabat EU numbering system;

g) introducing a K392D mutation in the first antibody or fragment thereof, and introducing a D399R mutation in the second antibody or fragment thereof, numbered according to the Kabat EU numbering system;

h) introducing a K392D mutation in the first antibody or fragment thereof, and introducing a D399K mutation in the second antibody or fragment thereof, numbered according to the Kabat EU numbering system;

i) introducing K409D and K360D mutations in the first antibody or fragment thereof, and introducing D399K and E356K mutations in the second antibody or fragment thereof, numbered according to the Kabat EU numbering system;

j) introducing K409D and K370D mutations in the first antibody or fragment thereof, and introducing D399K and E357K mutations in the second antibody or fragment thereof, numbered according to the Kabat EU numbering system;

k) introducing K409D and K392D mutations in the first antibody or fragment thereof, and introducing D399K, E356K, and E357K mutations in the second antibody or fragment thereof, numbered according to the Kabat EU numbering system;

l) introducing K409D and K392D mutations in the first antibody or fragment thereof, and introducing a D399K mutation in the second antibody or fragment thereof, numbered according to the Kabat EU numbering system;

m) introducing K409D and K392D mutations in the first antibody or fragment thereof, and introducing D399K and E356K mutations in the second antibody or fragment thereof, numbered according to the Kabat EU numbering system;

n) introducing K409D and K392D mutations in the first antibody or fragment thereof, and introducing D399K and E357K mutations in the second antibody or fragment thereof, numbered according to the Kabat EU numbering system;

o) introducing K409D and K370D mutations in the first antibody or fragment thereof, and introducing D399K and E357K mutations in the second antibody or fragment thereof, numbered according to the Kabat EU numbering system;

p) introducing a D399K mutation in the first antibody or fragment thereof, and introducing K409D and K360D mutations in the second antibody or fragment thereof, numbered according to the Kabat EU numbering system;

q) introducing K409D and K439D mutations in the first antibody or fragment thereof, and introducing D399K and E356K mutations in the second antibody or fragment thereof, numbered according to the Kabat EU numbering system;

r) introducing a K409E mutation in the second antibody or fragment thereof, and introducing a D399K mutation in the first antibody or fragment thereof, numbered according to the Kabat EU numbering system;

s) introducing a K409E mutation in the second antibody or fragment thereof, and introducing a D399R mutation in the first antibody or fragment thereof, numbered according to the Kabat EU numbering system;

t) introducing a K409D mutation in the second antibody or fragment thereof, and introducing a D399K mutation in the first antibody or fragment thereof, numbered according to the Kabat EU numbering system;

u) introducing a K409D mutation in the second antibody or fragment thereof, and introducing a D399R mutation in the first antibody or fragment thereof, numbered according to the Kabat EU numbering system;

v) introducing a K392E mutation in the second antibody or fragment thereof, and introducing a D399R mutation in the first antibody or fragment thereof, numbered according to the Kabat EU numbering system;

w) introducing a K392E mutation in the second antibody or fragment thereof, and introducing a D399K mutation in the first antibody or fragment thereof, numbered according to the Kabat EU numbering system;

x) introducing a K392D mutation in the second antibody or fragment thereof, and introducing a D399R mutation in the first antibody or fragment thereof, numbered according to the Kabat EU numbering system;

y) introducing a K392D mutation in the second antibody or fragment thereof, and introducing a D399K mutation in the first antibody or fragment thereof, numbered according to the Kabat EU numbering system;

z) introducing K409D and K360D mutations in the second antibody or fragment thereof, and introducing D399K and E356K mutations in the first antibody or fragment thereof, numbered according to the Kabat EU numbering system;

aa) introducing K409D and K370D mutations in the second antibody or fragment thereof, and introducing D399K and E357K mutations in the first antibody or fragment thereof, numbered according to the Kabat EU numbering system;

ab) introducing K409D and K392D mutations in the second antibody or fragment thereof, and introducing D399K, E356K, and E357K mutations in the first antibody or fragment thereof, numbered according to the Kabat EU numbering system;

ac) introducing K409D and K392D mutations in the second antibody or fragment thereof, and introducing a D399K mutation in the first antibody or fragment thereof, numbered according to the Kabat EU numbering system;

ad) introducing K409D and K392D mutations in the second antibody or fragment thereof, and introducing D399K and E356K mutations in the first antibody or fragment thereof, numbered according to the Kabat EU numbering system;

ae) introducing K409D and K392D mutations in the second antibody or fragment thereof, and introducing D399K and E357K mutations in the first antibody or fragment thereof, numbered according to the Kabat EU numbering system;

af) introducing K409D and K370D mutations in the second antibody or fragment thereof, and introducing D399K and E357K mutations in the first antibody or fragment thereof, numbered according to the Kabat EU numbering system;

ag) introducing a D399K mutation in the second antibody or fragment thereof, and introducing K409D and K360D mutations in the first antibody or fragment thereof, numbered according to the Kabat EU numbering system; or ah) introducing K409D and K439D mutations in the second antibody or fragment thereof, and introducing D399K and E356K mutations in the first antibody or fragment thereof, numbered according to the Kabat EU numbering system.

375. The masked cytokine of any one of embodiments 352-365, wherein the amino acid sequence of the first antibody or fragment thereof and the amino acid sequence of the second antibody or fragment thereof are produced by:

a) introducing a K409E mutation in the amino acid sequence of SEQ ID NO: 154 or 169, and introducing a D399K mutation in the amino acid sequence of SEQ ID NO: 154 or 169, respectively, numbered according to the Kabat EU numbering system;

b) introducing a K409E mutation in the amino acid sequence of SEQ ID NO: 154 or 169, and introducing a D399R mutation in the amino acid sequence of SEQ ID NO: 154 or 169, respectively, numbered according to the Kabat EU numbering system;

c) introducing a K409D mutation in the amino acid sequence of SEQ ID NO: 154 or 169, and introducing a D399K mutation in the amino acid sequence of SEQ ID NO: 154 or 169, respectively, numbered according to the Kabat EU numbering system;

d) introducing a K409D mutation in the amino acid sequence of SEQ ID NO: 154 or 169, and introducing a D399R mutation in the amino acid sequence of SEQ ID NO: 154 or 169, respectively, numbered according to the Kabat EU numbering system;

e) introducing a K392E mutation in the amino acid sequence of SEQ ID NO: 154 or 169, and introducing a D399R mutation in the amino acid sequence of SEQ ID NO: 154 or 169, respectively, numbered according to the Kabat EU numbering system;

f) introducing a K392E mutation in the amino acid sequence of SEQ ID NO: 154 or 169, and introducing a D399K mutation in the amino acid sequence of SEQ ID NO: 154 or 169, respectively, numbered according to the Kabat EU numbering system;

g) introducing a K392D mutation in the amino acid sequence of SEQ ID NO: 154 or 169, and introducing a D399R mutation in the amino acid sequence of SEQ ID NO: 154 or 169, respectively, numbered according to the Kabat EU numbering system;

h) introducing a K392D mutation in the amino acid sequence of SEQ ID NO: 154 or 169, and introducing a D399K mutation in the amino acid sequence of SEQ ID NO: 154 or 169, respectively, numbered according to the Kabat EU numbering system;

i) introducing K409D and K360D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

j) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

k) introducing K409D and K392D mutations in the amino acid sequence of SEQ ID NO: 154 or 169, and introducing D399K, E356K, and E357K mutations in the amino acid sequence of SEQ ID NO: 154 or 169, respectively, numbered according to the Kabat EU numbering system;

l) introducing K409D and K392D mutations in the amino acid sequence of SEQ ID NO: 154 or 169, and introducing a D399K mutation in the amino acid sequence of SEQ ID NO: 154 or 169, respectively, numbered according to the Kabat EU numbering system;

m) introducing K409D and K392D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

n) introducing K409D and K392D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

o) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

p) introducing a D399K mutation in the amino acid sequence of SEQ ID NO: 154 or 169, and introducing K409D and K360D mutations in the amino acid sequence of SEQ ID NO: 154 or 169, respectively, numbered according to the Kabat EU numbering system;

q) introducing K409D and K439D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

r) introducing a K409E mutation in the amino acid sequence of SEQ ID NO: 154 or 169, and introducing a D399K mutation in the amino acid sequence of SEQ ID NO: 154 or 169, respectively, numbered according to the Kabat EU numbering system;

s) introducing a K409E mutation in the amino acid sequence of SEQ ID NO: 154 or 169, and introducing a D399R mutation in the amino acid sequence of SEQ ID NO: 154 or 169, respectively, numbered according to the Kabat EU numbering system;

t) introducing a K409D mutation in the amino acid sequence of SEQ ID NO: 154 or 169, and introducing a D399K mutation in the amino acid sequence of SEQ ID NO: 154 or 169, respectively, numbered according to the Kabat EU numbering system;

u) introducing a K409D mutation in the amino acid sequence of SEQ ID NO: 154 or 169, and introducing a D399R mutation in the amino acid sequence of SEQ ID NO: 154 or 169, respectively, numbered according to the Kabat EU numbering system;

v) introducing a K392E mutation in the amino acid sequence of SEQ ID NO: 154 or 169, and introducing a D399R mutation in the amino acid sequence of SEQ ID NO: 154 or 169, respectively, numbered according to the Kabat EU numbering system;

w) introducing a K392E mutation in the amino acid sequence of SEQ ID NO: 154 or 169, and introducing a D399K mutation in the amino acid sequence of SEQ ID NO: 154 or 169, respectively, numbered according to the Kabat EU numbering system;

x) introducing a K392D mutation in the amino acid sequence of SEQ ID NO: 154 or 169, and introducing a D399R mutation in the amino acid sequence of SEQ ID NO: 154 or 169, respectively, numbered according to the Kabat EU numbering system;

y) introducing a K392D mutation in the amino acid sequence of SEQ ID NO: 154 or 169, and introducing a D399K mutation in the amino acid sequence of SEQ ID NO: 154 or 169, respectively, numbered according to the Kabat EU numbering system;

z) introducing K409D and K360D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system;

aa) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

ab) introducing K409D and K392D mutations in the amino acid sequence of SEQ ID NO: 154 or 169, and introducing D399K, E356K, and E357K mutations in the amino acid sequence of SEQ ID NO: 154 or 169, respectively, numbered according to the Kabat EU numbering system;

ac) introducing K409D and K392D mutations in the amino acid sequence of SEQ ID NO: 154 or 169, and introducing a D399K mutation in the amino acid sequence of SEQ ID NO: 154 or 169, respectively, numbered according to the Kabat EU numbering system;

ad) introducing K409D and K392D mutations in the amino acid sequence of SEQ ID NO: 154 or 169, and introducing D399K and E356K mutations in the amino acid sequence of SEQ ID NO: 154 or 169, numbered according to the Kabat EU numbering system;

ae) introducing K409D and K392D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

af) introducing K409D and K370D mutations in the amino acid sequence of SEQ ID NO: 154 or 169, and introducing D399K and E357K mutations in the amino acid sequence of SEQ ID NO: 154 or 169, respectively, numbered according to the Kabat EU numbering system;

ag) introducing a D399K mutation in the amino acid sequence of SEQ ID NO: 154 or 169, and introducing K409D and K360D mutations in the amino acid sequence of SEQ ID NO: 154 or 169, respectively, numbered according to the Kabat EU numbering system; or ah) introducing K409D and K439D mutations in the amino acid sequence of SEQ ID NO: 154 or 169, and introducing D399K and E356K mutations in the amino acid sequence of SEQ ID NO: 154 or 169, respectively, numbered according to the Kabat EU numbering system.

376. The masked cytokine of any one of embodiments 333-375, wherein the first linker comprises a first cleavable peptide; and/or wherein the second linker comprises a second cleavable peptide.

377. The masked cytokine of any one of embodiments 333-376, wherein the first linker comprises a first N-terminal spacer domain, and/or a first C-terminal spacer domain.

378. The masked cytokine of embodiment 377, wherein the first linker comprises:
a) the first N-terminal spacer domain, the first cleavable peptide, and the first C-terminal spacer domain;
b) the first N-terminal spacer domain and the first cleavable peptide;
c) the first N-terminal spacer domain and the first C-terminal spacer domain;
d) the first cleavable peptide and the first C-terminal spacer domain;
e) the first N-terminal spacer domain; or
f) the first C-terminal spacer domain.

379. The masked cytokine of any one of embodiments 333-378, wherein the second linker comprises a second N-terminal spacer domain, and/or a second C-terminal spacer domain.

380. The masked cytokine of embodiment 379, wherein the second linker comprises:
a) the second N-terminal spacer domain, the second cleavable peptide, and the second C-terminal spacer domain;

b) the second N-terminal spacer domain and the second cleavable peptide;

c) the second N-terminal spacer domain and the second C-terminal spacer domain;

d) the second cleavable peptide and the second C-terminal spacer domain;

e) the second N-terminal spacer domain; or f) the second C-terminal spacer domain.

381. The masked cytokine of any one of embodiments 376-380, wherein the first cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555; and/or wherein the second cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555.

382. The masked cytokine of any one of embodiments 377-381, wherein the first N-terminal spacer domain comprises an amino acid sequence selected from the group consisting of SEQ ID NOs: 20-95, 235, 268, 269, 303-305, 323-338, 340, 341, 727, 794, and 799, and/or the first C-terminal spacer domain comprises an amino acid sequence selected from the group consisting of SEQ ID NOs: 20-95, 235, 268, 269, 303-305, 323-338, 340, 341, 727, 794, and 799.

383. The masked cytokine of any one of embodiments 376-380, wherein the first cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

384. The masked cytokine of embodiment 383, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

385. The masked cytokine of any one of embodiments 379-384, wherein the second N-terminal spacer domain comprises an amino acid sequence selected from the group consisting of SEQ ID NOs: 20-95, 235, 268, 269, 303-305, 323-338, 340, 341, 727, 794, and 799, and/or the second C-terminal spacer domain comprises an amino acid sequence selected from the group consisting of SEQ ID NOs: 20-95, 235, 268, 269, 303-305, 323-338, 340, 341, 727, 794, and 799.

386. The masked cytokine of any one of embodiments 376-385, wherein the second cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

387. The masked cytokine of embodiment 386, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

388. The masked cytokine of any one of embodiments 333-387, wherein the first linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812, and/or the second linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812.

389. The masked cytokine of any one of embodiments 334-388, wherein the third linker comprises a third cleavable peptide.

390. The masked cytokine of any one of embodiments 334-389, wherein the third linker comprises a third N-terminal spacer domain, and/or a third C-terminal spacer domain.

391. The masked cytokine of embodiment 390, wherein the third linker comprises:

a) the third N-terminal spacer domain, the third cleavable peptide, and the third C-terminal spacer domain;

b) the third N-terminal spacer domain and the third cleavable peptide;

c) the third N-terminal spacer domain and the third C-terminal spacer domain;

d) the third cleavable peptide and the third C-terminal spacer domain;

e) the third N-terminal spacer domain; or f) the third C-terminal spacer domain.

392. The masked cytokine of any one of embodiments 389-391, wherein the third cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555; and/or wherein the third cleavable peptide comprises an amino acid sequence selected from the group consisting of SEQ ID NOs: 96-153, 236-242, 264, 270-302, 306-317, 342-347, 356-415, 420-491, 494-501, 504-535, and 538-555.

393. The masked cytokine of any one of embodiments 390-392, wherein the third N-terminal spacer domain comprises an amino acid sequence selected from the group consisting of SEQ ID NOs: 20-95, 235, 268, 269, 303-305, 323-338, 340, 341, 727, 794, and 799, and/or the third C-terminal spacer domain comprises an amino acid sequence selected from the group consisting of SEQ ID NOs: 20-95, 235, 268, 269, 303-305, 323-338, 340, 341, 727, 794, and 799.

394. The masked cytokine of any one of embodiments 389-393, wherein the third cleavable peptide comprises an amino acid sequence selected from the group consisting of SEQ ID NOs: 96-153, 264, 270-302, 306-317, 342-347, 356-415, 420-491, 494-501, 504-535, and 538-555, and an amino acid sequence selected from the group consisting of SEQ ID NOs: 236-242.

395. The masked cytokine of embodiment 394, wherein the amino acid sequence selected from the group consisting of SEQ ID NOs: 96-153, 264, 270-302, 306-317, 342-347, 356-415, 420-491, 494-501, 504-535, and 538-555 comprises an N-terminus and a C-terminus, and the amino acid sequence selected from the group consisting of SEQ ID NOs: 236-242 is linked to the N-terminus or the C-terminus of the amino acid sequence selected from the group consisting of SEQ ID NOs: 96-153, 264, 270-302, 306-317, 342-347, 356-415, 420-491, 494-501, 504-535, and 538-555.

396. The masked cytokine of any one of embodiments 334-395, wherein the third linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812, and/or the third linker comprises an amino acid sequence selected from the group consisting of SEQ ID NOs: 11-153, 235-242, 262-264, 268-320, 323-338, 340-354, 356-555, 668, 691, 724, 725, 727, 762-771, 794, and 797-812.

397. The masked cytokine of any one of embodiments 368-396, wherein the fourth linker comprises a fourth N-terminal spacer domain, and/or a fourth C-terminal spacer domain.

398. The masked cytokine of embodiment 397, wherein the fourth N-terminal spacer domain comprises an amino acid sequence selected from the group consisting of SEQ ID NOs: 20-95, 235, 268, 269, 303-305, 323-338, 340, 341, 727, 794, and 799, and/or the fourth C-terminal spacer domain comprises an amino acid sequence selected from the group consisting of SEQ ID NOs: 20-95, 235, 268, 269, 303-305, 323-338, 340, 341, 727, 794, and 799.

399. The masked cytokine of any one of embodiments 376-398, wherein the first cleavable peptide, the second cleavable peptide, and/or the third cleavable peptide is a substrate for a protease that is co-localized in a region or a tissue expressing a cytokine receptor.

400. The masked cytokine of embodiment 399, wherein the cytokine receptor is an IL-2 cytokine receptor or an IL-15 cytokine receptor.

401. The masked cytokine of any one of embodiments 376-400, wherein the first cleavable peptide, the second cleavable peptide, and/or the third cleavable peptide is cleaved by one or more enzyme selected from the group consisting of: ABHD12, ADAM12, ABHD12B, ABHD13, ABHD17A, ADAM19, ADAM20, ADAM21, ADAM28, ADAM30, ADAM33, ADAM8, ABHD17A, ADAMDEC1, ADAMTS1, ADAMTS10, ADAMTS12, ADAMTS13, ADAMTS14, ADAMTS15, ADAMTS16, ADAMTS17, ADAMTS18, ADAMTS19, ADAMTS2, ADAMTS20, ADAMTS3, ADAMTS4, ABHD17B, ADAMTS5, ADAMTS6, ADAMTS7, ADAMTS8, ADAMTS9, ADAMTSL1, ADAMTSL2, ADAMTSL3, ABHD17C, ADAMTSL5, ASTL, BMP1, CELA1, CELA2A, CELA2B, CELA3A, CELA3B, ADAM10, ADAM15, ADAM17, ADAM9, ADAMTS4, CTSE, CTSF, ADAMTSL4, CMA1, CTRB1, CTRC, CTSO, CTR1, CTSA, CTSW, CTSB, CTSC, CTSD, ESP1, CTSG, CTSH, GZMA, GZMB, GZMH, CTSK, GZMM, CTSL, CTSS, CTSV, CTSZ, HTRA4, KLK10, KLK11, KLK13, KLK14, KLK2, KLK4, DPP4, KLK6, KLK7, KLKB1, ECE1, ECE2, ECEL1, MASP2, MEP1A, MEP1B, ELANE, FAP, GZMA, MMP11, GZMK, HGFAC, HPN, HTRA1, MMP11, MMP16, MMP17, MMP19, HTRA2, MMP20, MMP21, HTRA3, HTRA4, KEL, MMP23B, MMP24, MMP25, MMP26, MMP27, MMP28, KLK5, MMP3, MMP7, MMP8, MMP9, LGMN, LNPEP, MASP1, PAPPA, PAPPA2, PCSK1, NAPSA, PCSK5, PCSK6, MME, MMP1, MMP10, PLAT, PLAU, PLG, PRSS1, PRSS12, PRSS2, PRSS21, PRSS3, PRSS33, PRSS4, PRSS55, PRSS57, MMP12, PRSS8, PRSS9, PRTN3, MMP13, MMP14, ST14, TMPRSS10, TMPRSS11A, TMPRSS11D, TMPRSS11E, TMPRSS11F, TMPRSS12, TMPRSS13, MMP15, TMPRSS15, MMP2, TMPRSS2, TMPRSS3, TMPRSS4, TMPRSS5, TMPRSS6, TMPRSS7, TMPRSS9, NRDC, OVCH1, PAMR1, PCSK3, PHEX, TINAG, TPSAB1, TPSD1, and TPSG1.

402. The masked cytokine of any one of embodiments 332-401, wherein the first half-life extension domain and/or the second half-life extension domain is conjugated to an agent.

403. The masked cytokine of embodiment 402, wherein the agent is an inhibitor of tubulin polymerization, a DNA damaging agent, or a DNA synthesis inhibitor.

404. The masked cytokine of embodiment 403, wherein the agent is a maytansinoid, an auristatin, a pyrrolobenzodiazepine (PBD) dimer, a calicheamicin, a duocarmycin, a indo-linobenzodiazepine dimer or exatecan derivative Dxd.

405. The masked cytokine of embodiment 402, wherein the agent is an immune stimulant.

406. The masked cytokine of embodiment 405, wherein the immune stimulant is a stimulator of interferon genes (STING) agonist or a toll-like receptor (TLR) agonist.

407. The masked cytokine of embodiment 406, wherein the STING agonist is a cyclic dinucleotide (CDN).

408. The masked cytokine of embodiment 407, wherein the CDN is selected from the group consisting of cGAMP, c-di-AMP, c-di-GMP, cAIMP, c-di-IMP, 4-(2-chloro-6-fluorobenzyl)-N-(furan-2-ylmethyl)-3-oxo-3,4-dihydro-2H-benzo[b][1,4]thiazine-6-carboxamide.

409. The masked cytokine of embodiment 406, wherein the TLR agonist is an agonist of a TLR selected from the group consisting of TLR1, TLR2, TLR3, TLR4, TLR5, TLR6, TLR7, TLR8, TLR9, and TLR10.

VIII. EXAMPLES

The invention will be more fully understood by reference to the following examples. They should not, however, be construed as limiting the scope of the invention. It is understood that the examples and embodiments described herein are for illustrative purposes only and that various modifications or changes in light thereof will be suggested to persons skilled in the art and are to be included within the spirit and purview of this application and scope of the appended claims.

Although some examples describe the engineering, production, and/or testing of "masked" versions of an IL-2 polypeptide construct or IL-15 polypeptide construct, some examples also employ parental "non-masked" versions of the IL-2 polypeptide construct or IL-15 polypeptide construct, such as for comparison, or other constructs that include one or more of the components described herein that are tested as controls for comparison. Accordingly, the description of, for instance, testing done on masked IL-2 polypeptide constructs does not necessarily mean that non-masked versions of the construct were not also tested.

Example 1: Engineering of Masked IL-2 Polypeptides and Masked IL-15 Polypeptides Masked IL-2 polypeptide constructs and masked IL-15 polypeptide constructs are generated in accordance with the teachings herein. In the subsequent examples, some experiments involve use of the masked IL-2 and IL-15 polypeptide constructs in monomer form, and some experiments involve use of the masked IL-2 and IL-15 polypeptide constructs in dimer form, such as a dimer formed through disulfide bonds linking two copies of the same masked polypeptide construct (homodimer), or a heterodimer formed by two different polypeptides (see, e.g., Tables 8-11).

Masked IL-2 polypeptide constructs are generated that include an IL-2 polypeptide or functional fragment thereof, a masking moiety, and a half-life extension domain, such as albumin, an antibody or fragment thereof (e.g., an Fc region, heavy chain, and/or light chain), an albumin-binding peptide, an IgG-binding peptide, or a polyamino acid sequence. Some IL-2 polypeptide constructs are also generated that include an IL-2 polypeptide or functional fragment thereof linked to a half-life extension domain without also including a masking moiety. Some of the constructs also include a linker that comprises a cleavable peptide and links the masking moiety to the IL-2 polypeptide or functional fragment thereof, thereby resulting in an activatable masked IL-2 polypeptide construct. Some of the constructs also include a linker that links the IL-2 polypeptide or functional fragment thereof to the half-life extension domain. Some of the constructs also include a linker that links the IL-2 polypeptide or functional fragment thereof to the masking moiety. The masked IL-2 polypeptide constructs that do not include a cleavable peptide in the linker that links the IL-2 polypeptide or functional fragment thereof to the masking moiety are also referred to as non-activatable masked IL-2 polypeptide constructs or non-activatable IL-2 polypeptide constructs because they do not include a cleavable peptide. The structure and composition of exemplary IL-2 polypeptide constructs are provided in Table 4.

TABLE 4

| Construct # | Cytokine or functional fragment thereof (C) | Linker (L1) | Masking moiety (MM) | Linker (L2) | Half-life extension domain (H) | Structure (N- to C-terminal direction) | Amino Acid Sequence |
|---|---|---|---|---|---|---|---|
| 2001 | SEQ ID NO: 1 | — | — | — | SEQ ID NO: 154 | H-C | |
| 2002 | SEQ ID NO: 1 | SEQ ID NO: 20 | SEQ ID NO: 9 | — | SEQ ID NO: 154 | H-L1-MM-C | |
| 2003 | SEQ ID NO: 1 | SEQ ID NO: 21 | SEQ ID NO: 9 | — | SEQ ID NO: 154 | C-L1-MM-H | |
| 2004 | SEQ ID NO: 3 | — | — | — | SEQ ID NO: 154 | H-C | |
| 2005 | SEQ ID NO: 4 | — | — | — | SEQ ID NO: 154 | H-C | |
| 2006 | SEQ ID NO: 5 | — | — | — | SEQ ID NO: 154 | H-C | |
| 2014 | SEQ ID NO: 1 | — | SEQ ID NO: 10 | SEQ ID NO: 15 | SEQ ID NO: 154 | H-C-L2-MM | |
| 2017 | SEQ ID NO: 3 | — | SEQ ID NO: 10 | SEQ ID NO: 15 | SEQ ID NO: 154 | H-C-L2-MM | |
| 2018 | SEQ ID NO: 4 | — | SEQ ID NO: 10 | SEQ ID NO: 15 | SEQ ID NO: 154 | H-C-L2-MM | |
| 2019 | SEQ ID NO: 5 | — | SEQ ID NO: 10 | SEQ ID NO: 15 | SEQ ID NO: 154 | H-C-L2-MM | |
| 2024 | SEQ ID NO: 6 | — | — | — | SEQ ID NO: 154 | H-C | |
| 2025 | SEQ ID NO: 7 | — | — | — | SEQ ID NO: 154 | H-C | |
| 2026 | SEQ ID NO: 8 | — | — | — | SEQ ID NO: 154 | H-C | |
| 2027 | SEQ ID NO: 1 | SEQ ID NO: 20 | SEQ ID NO: 9 | SEQ ID NO: 30 | SEQ ID NO: 154 | H-L1-MM-L2-C | |
| 2028 | SEQ ID NO: 1 | SEQ ID NO: 20 | SEQ ID NO: 9 | SEQ ID NO: 31 | SEQ ID NO: 154 | H-L1-MM-L2-C | |
| 2029 | SEQ ID NO: 1 | SEQ ID NO: 20 | SEQ ID NO: 9 | SEQ ID NO: 32 | SEQ ID NO: 154 | H-L1-MM-L2-C | |
| 2030 | SEQ ID NO: 1 | SEQ ID NO: 20 | SEQ ID NO: 9 | SEQ ID NO: 33 | SEQ ID NO: 154 | H-L1-MM-L2-C | |
| 2031 | SEQ ID NO: 2 | SEQ ID NO: 20 | SEQ ID NO: 9 | SEQ ID NO: 29 | SEQ ID NO: 154 | H-L1-MM-L2-C | |
| 2032 | SEQ ID NO: 2 | SEQ ID NO: 20 | SEQ ID NO: 9 | SEQ ID NO: 30 | SEQ ID NO: 154 | H-L1-MM-L2-C | |
| 2033 | SEQ ID NO: 2 | SEQ ID NO: 20 | SEQ ID NO: 9 | SEQ ID NO: 31 | SEQ ID NO: 154 | H-L1-MM-L2-C | |
| 2034 | SEQ ID NO: 2 | SEQ ID NO: 20 | SEQ ID NO: 9 | SEQ ID NO: 32 | SEQ ID NO: 154 | H-L1-MM-L2-C | |
| 2035 | SEQ ID NO: 2 | SEQ ID NO: 20 | SEQ ID NO: 9 | SEQ ID NO: 33 | SEQ ID NO: 154 | H-L1-MM-L2-C | |
| 2036 | SEQ ID NO: 1 | SEQ ID NO: 26 | SEQ ID NO: 9 | — | SEQ ID NO: 154 | C-L1-MM-H | |
| 2037 | SEQ ID NO: 1 | SEQ ID NO: 27 | SEQ ID NO: 9 | — | SEQ ID NO: 154 | C-L1-MM-H | |
| 2038 | SEQ ID NO: 2 | SEQ ID NO: 20 | SEQ ID NO: 9 | — | SEQ ID NO: 154 | C-L1-MM-H | |
| 2039 | SEQ ID NO: 2 | SEQ ID NO: 20 | SEQ ID NO: 9 | — | SEQ ID NO: 154 | C-L1-MM-H | |
| 2040 | SEQ ID NO: 2 | SEQ ID NO: 20 | SEQ ID NO: 9 | — | SEQ ID NO: 154 | C-L1-MM-H | |
| 2041 | SEQ ID NO: 1 | — | SEQ ID NO: 10 | SEQ ID NO: 16 | SEQ ID NO: 154 | H-C-L2-MM | |
| 2042 | SEQ ID NO: 1 | — | SEQ ID NO: 10 | SEQ ID NO: 17 | SEQ ID NO: 154 | H-C-L2-MM | |
| 2043 | SEQ ID NO: 1 | — | SEQ ID NO: 10 | SEQ ID NO: 18 | SEQ ID NO: 154 | H-C-L2-MM | |
| 2044 | SEQ ID NO: 1 | — | SEQ ID NO: 10 | SEQ ID NO: 19 | SEQ ID NO: 154 | H-C-L2-MM | |
| 2045 | SEQ ID NO: 3 | — | SEQ ID NO: 10 | SEQ ID NO: 16 | SEQ ID NO: 154 | H-C-L2-MM | |
| 2046 | SEQ ID NO: 3 | — | SEQ ID NO: 10 | SEQ ID NO: 17 | SEQ ID NO: 154 | H-C-L2-MM | |
| 2047 | SEQ ID NO: 3 | — | SEQ ID NO: 10 | SEQ ID NO: 18 | SEQ ID NO: 154 | H-C-L2-MM | |
| 2048 | SEQ ID NO: 3 | — | SEQ ID NO: 10 | SEQ ID NO: 19 | SEQ ID NO: 154 | H-C-L2-MM | |
| 2049 | SEQ ID NO: 4 | — | SEQ ID NO: 10 | SEQ ID NO: 16 | SEQ ID NO: 154 | H-C-L2-MM | |
| 2050 | SEQ ID NO: 4 | — | SEQ ID NO: 10 | SEQ ID NO: 17 | SEQ ID NO: 154 | H-C-L2-MM | |
| 2051 | SEQ ID NO: 4 | — | SEQ ID NO: 10 | SEQ ID NO: 18 | SEQ ID NO: 154 | H-C-L2-MM | |
| 2052 | SEQ ID NO: 4 | — | SEQ ID NO: 10 | SEQ ID NO: 19 | SEQ ID NO: 154 | H-C-L2-MM | |
| 2053 | SEQ ID NO: 5 | — | SEQ ID NO: 10 | SEQ ID NO: 16 | SEQ ID NO: 154 | H-C-L2-MM | |
| 2054 | SEQ ID NO: 5 | — | SEQ ID NO: 10 | SEQ ID NO: 17 | SEQ ID NO: 154 | H-C-L2-MM | |
| 2055 | SEQ ID NO: 5 | — | SEQ ID NO: 10 | SEQ ID NO: 18 | SEQ ID NO: 154 | H-C-L2-MM | |
| 2056 | SEQ ID NO: 5 | — | SEQ ID NO: 10 | SEQ ID NO: 19 | SEQ ID NO: 154 | H-C-L2-MM | |
| 2057 | SEQ ID NO: 6 | — | SEQ ID NO: 10 | SEQ ID NO: 15 | SEQ ID NO: 154 | H-C-L2-MM | |
| 2058 | SEQ ID NO: 6 | — | SEQ ID NO: 10 | SEQ ID NO: 16 | SEQ ID NO: 154 | H-C-L2-MM | |
| 2059 | SEQ ID NO: 6 | — | SEQ ID NO: 10 | SEQ ID NO: 17 | SEQ ID NO: 154 | H-C-L2-MM | |
| 2060 | SEQ ID NO: 6 | — | SEQ ID NO: 10 | SEQ ID NO: 18 | SEQ ID NO: 154 | H-C-L2-MM | |
| 2061 | SEQ ID NO: 6 | — | SEQ ID NO: 10 | SEQ ID NO: 19 | SEQ ID NO: 154 | H-C-L2-MM | |
| 2062 | SEQ ID NO: 7 | — | SEQ ID NO: 10 | SEQ ID NO: 15 | SEQ ID NO: 154 | H-C-L2-MM | |
| 2063 | SEQ ID NO: 7 | — | SEQ ID NO: 10 | SEQ ID NO: 16 | SEQ ID NO: 154 | H-C-L2-MM | |
| 2064 | SEQ ID NO: 7 | — | SEQ ID NO: 10 | SEQ ID NO: 17 | SEQ ID NO: 154 | H-C-L2-MM | |
| 2065 | SEQ ID NO: 7 | — | SEQ ID NO: 10 | SEQ ID NO: 18 | SEQ ID NO: 154 | H-C-L2-MM | |
| 2066 | SEQ ID NO: 7 | — | SEQ ID NO: 10 | SEQ ID NO: 19 | SEQ ID NO: 154 | H-C-L2-MM | |
| 2067 | SEQ ID NO: 8 | — | SEQ ID NO: 10 | SEQ ID NO: 15 | SEQ ID NO: 154 | H-C-L2-MM | |
| 2068 | SEQ ID NO: 8 | — | SEQ ID NO: 10 | SEQ ID NO: 16 | SEQ ID NO: 154 | H-C-L2-MM | |
| 2069 | SEQ ID NO: 8 | — | SEQ ID NO: 10 | SEQ ID NO: 17 | SEQ ID NO: 154 | H-C-L2-MM | |
| 2070 | SEQ ID NO: 8 | — | SEQ ID NO: 10 | SEQ ID NO: 18 | SEQ ID NO: 154 | H-C-L2-MM | |
| 2071 | SEQ ID NO: 8 | — | SEQ ID NO: 10 | SEQ ID NO: 19 | SEQ ID NO: 154 | H-C-L2-MM | |
| 2109 | SEQ ID NO: 2 | — | — | — | SEQ ID NO: 154 | H-C | |

TABLE 4-continued

| Construct # | Cytokine or functional fragment thereof (C) | Linker (L1) | Masking moiety (MM) | Linker (L2) | Half-life extension domain (H) | Structure (N- to C-terminal direction) | Amino Acid Sequence |
|---|---|---|---|---|---|---|---|
| AK032 | SEQ ID NO: 1 | — | — | — | SEQ ID NO: 154 | H-C | SEQ ID NO: 556 |
| AK033 | SEQ ID NO: 1 | SEQ ID NO: 20 | SEQ ID NO: 9 | SEQ ID NO: 29 | SEQ ID NO: 154 | H-L1-MM-L2-C | SEQ ID NO: 557 |
| AK034 | SEQ ID NO: 1 | SEQ ID NO: 21 | SEQ ID NO: 9 | — | SEQ ID NO: 154 | C-L1-MM-H | SEQ ID NO: 558 |
| AK035 | SEQ ID NO: 3 | — | — | — | SEQ ID NO: 154 | H-C | SEQ ID NO: 559 |
| AK036 | SEQ ID NO: 4 | — | — | — | SEQ ID NO: 154 | H-C | SEQ ID NO: 560 |
| AK037 | SEQ ID NO: 5 | — | — | — | SEQ ID NO: 154 | H-C | SEQ ID NO: 561 |
| AK040 | SEQ ID NO: 1 | SEQ ID NO: 15 | SEQ ID NO: 10 | — | SEQ ID NO: 154 | H-C-L1-MM | SEQ ID NO: 566 |
| AK042 | SEQ ID NO: 6 | — | — | — | SEQ ID NO: 154 | H-C | SEQ ID NO: 568 |
| AK043 | SEQ ID NO: 7 | — | — | — | SEQ ID NO: 154 | H-C | SEQ ID NO: 569 |
| AK044 | SEQ ID NO: 8 | — | — | — | SEQ ID NO: 154 | H-C | SEQ ID NO: 570 |
| AK045 | SEQ ID NO: 1 | SEQ ID NO: 20 | SEQ ID NO: 9 | SEQ ID NO: 30 | SEQ ID NO: 154 | H-L1-MM-L2-C | SEQ ID NO: 571 |
| AK046 | SEQ ID NO: 1 | SEQ ID NO: 20 | SEQ ID NO: 9 | SEQ ID NO: 31 | SEQ ID NO: 154 | H-L1-MM-L2-C | SEQ ID NO: 572 |
| AK047 | SEQ ID NO: 1 | SEQ ID NO: 20 | SEQ ID NO: 9 | SEQ ID NO: 32 | SEQ ID NO: 154 | H-L1-MM-L2-C | SEQ ID NO: 573 |
| AK048 | SEQ ID NO: 1 | SEQ ID NO: 20 | SEQ ID NO: 9 | SEQ ID NO: 33 | SEQ ID NO: 154 | H-L1-MM-L2-C | SEQ ID NO: 574 |
| AK049 | SEQ ID NO: 2 | SEQ ID NO: 20 | SEQ ID NO: 9 | SEQ ID NO: 29 | SEQ ID NO: 154 | H-L1-MM-L2-C | SEQ ID NO: 575 |
| AK050 | SEQ ID NO: 2 | SEQ ID NO: 20 | SEQ ID NO: 9 | SEQ ID NO: 30 | SEQ ID NO: 154 | H-L1-MM-L2-C | SEQ ID NO: 576 |
| AK051 | SEQ ID NO: 2 | SEQ ID NO: 20 | SEQ ID NO: 9 | SEQ ID NO: 31 | SEQ ID NO: 154 | H-L1-MM-L2-C | SEQ ID NO: 577 |
| AK052 | SEQ ID NO: 2 | SEQ ID NO: 20 | SEQ ID NO: 9 | SEQ ID NO: 32 | SEQ ID NO: 154 | H-L1-MM-L2-C | SEQ ID NO: 578 |
| AK053 | SEQ ID NO: 2 | SEQ ID NO: 20 | SEQ ID NO: 9 | SEQ ID NO: 33 | SEQ ID NO: 154 | H-L1-MM-L2-C | SEQ ID NO: 579 |
| AK054 | SEQ ID NO: 1 | SEQ ID NO: 26 | SEQ ID NO: 9 | — | SEQ ID NO: 154 | C-L1-MM-H | SEQ ID NO: 580 |
| AK055 | SEQ ID NO: 1 | SEQ ID NO: 27 | SEQ ID NO: 9 | — | SEQ ID NO: 154 | C-L1-MM-H | SEQ ID NO: 581 |
| AK056 | SEQ ID NO: 2 | SEQ ID NO: 21 | SEQ ID NO: 9 | — | SEQ ID NO: 154 | C-L1-MM-H | SEQ ID NO: 582 |
| AK057 | SEQ ID NO: 2 | SEQ ID NO: 26 | SEQ ID NO: 9 | — | SEQ ID NO: 154 | C-L1-MM-H | SEQ ID NO: 583 |
| AK058 | SEQ ID NO: 2 | SEQ ID NO: 27 | SEQ ID NO: 9 | — | SEQ ID NO: 154 | C-L1-MM-H | SEQ ID NO: 584 |
| AK059 | SEQ ID NO: 1 | SEQ ID NO: 16 | SEQ ID NO: 10 | — | SEQ ID NO: 154 | H-C-L1-MM | SEQ ID NO: 585 |
| AK060 | SEQ ID NO: 1 | SEQ ID NO: 17 | SEQ ID NO: 10 | — | SEQ ID NO: 154 | H-C-L1-MM | SEQ ID NO: 586 |
| AK061 | SEQ ID NO: 1 | SEQ ID NO: 18 | SEQ ID NO: 10 | — | SEQ ID NO: 154 | H-C-L1-MM | SEQ ID NO: 587 |
| AK062 | SEQ ID NO: 1 | SEQ ID NO: 19 | SEQ ID NO: 10 | — | SEQ ID NO: 154 | H-C-L1-MM | SEQ ID NO: 588 |
| AK063 | SEQ ID NO: 3 | SEQ ID NO: 16 | SEQ ID NO: 10 | — | SEQ ID NO: 154 | H-C-L1-MM | SEQ ID NO: 589 |
| AK064 | SEQ ID NO: 3 | SEQ ID NO: 17 | SEQ ID NO: 10 | — | SEQ ID NO: 154 | H-C-L1-MM | SEQ ID NO: 590 |
| AK065 | SEQ ID NO: 3 | SEQ ID NO: 18 | SEQ ID NO: 10 | — | SEQ ID NO: 154 | H-C-L1-MM | SEQ ID NO: 591 |
| AK066 | SEQ ID NO: 3 | SEQ ID NO: 19 | SEQ ID NO: 10 | — | SEQ ID NO: 154 | H-C-L1-MM | SEQ ID NO: 592 |
| AK067 | SEQ ID NO: 6 | SEQ ID NO: 15 | SEQ ID NO: 10 | — | SEQ ID NO: 154 | H-C-L1-MM | SEQ ID NO: 593 |
| AK068 | SEQ ID NO: 6 | SEQ ID NO: 16 | SEQ ID NO: 10 | — | SEQ ID NO: 154 | H-C-L1-MM | SEQ ID NO: 594 |
| AK069 | SEQ ID NO: 6 | SEQ ID NO: 17 | SEQ ID NO: 10 | — | SEQ ID NO: 154 | H-C-L1-MM | SEQ ID NO: 595 |
| AK070 | SEQ ID NO: 6 | SEQ ID NO: 18 | SEQ ID NO: 10 | — | SEQ ID NO: 154 | H-C-L1-MM | SEQ ID NO: 596 |
| AK071 | SEQ ID NO: 6 | SEQ ID NO: 19 | SEQ ID NO: 10 | — | SEQ ID NO: 154 | H-C-L1-MM | SEQ ID NO: 597 |
| AK112 | SEQ ID NO: 1 | SEQ ID NO: 15 | SEQ ID NO: 261 | — | SEQ ID NO: 154 | H-C-L1-MM | SEQ ID NO: 602 |
| AK080 | SEQ ID NO: 2 | — | — | — | SEQ ID NO: 154 | H-C | SEQ ID NO: 607 |
| AK082 | — | SEQ ID NO: 28 | SEQ ID NO: 10 | — | SEQ ID NO: 155 | H-L1-MM | SEQ ID NO: 609 |
| AK083 | SEQ ID NO: 1 | SEQ ID NO: 15 | SEQ ID NO: 226 | — | SEQ ID NO: 154 | H-C-L1-MM | SEQ ID NO: 610 |
| AK084 | SEQ ID NO: 1 | SEQ ID NO: 16 | SEQ ID NO: 226 | — | SEQ ID NO: 154 | H-C-L1-MM | SEQ ID NO: 611 |
| AK085 | SEQ ID NO: 1 | SEQ ID NO: 17 | SEQ ID NO: 226 | — | SEQ ID NO: 154 | H-C-L1-MM | SEQ ID NO: 612 |
| AK086 | SEQ ID NO: 1 | SEQ ID NO: 18 | SEQ ID NO: 226 | — | SEQ ID NO: 154 | H-C-L1-MM | SEQ ID NO: 613 |
| AK087 | SEQ ID NO: 1 | SEQ ID NO: 19 | SEQ ID NO: 226 | — | SEQ ID NO: 154 | H-C-L1-MM | SEQ ID NO: 614 |
| AK096 | SEQ ID NO: 1 | SEQ ID NO: 762 | — | — | SEQ ID NO: 154 | H-C-L1 | SEQ ID NO: 627 |
| AK097 | SEQ ID NO: 1 | SEQ ID NO: 763 | — | — | SEQ ID NO: 154 | H-C-L1 | SEQ ID NO: 628 |
| AK098 | SEQ ID NO: 1 | SEQ ID NO: 764 | — | — | SEQ ID NO: 154 | H-C-L1 | SEQ ID NO: 629 |
| AK099 | SEQ ID NO: 1 | SEQ ID NO: 765 | — | — | SEQ ID NO: 154 | H-C-L1 | SEQ ID NO: 630 |
| AK100 | SEQ ID NO: 1 | SEQ ID NO: 766 | — | — | SEQ ID NO: 154 | H-C-L1 | SEQ ID NO: 631 |
| AK101 | SEQ ID NO: 1 | SEQ ID NO: 767 | — | — | SEQ ID NO: 154 | H-C-L1 | SEQ ID NO: 632 |
| AK102 | SEQ ID NO: 1 | SEQ ID NO: 768 | — | — | SEQ ID NO: 154 | H-C-L1 | SEQ ID NO: 633 |
| AK103 | SEQ ID NO: 1 | SEQ ID NO: 769 | — | — | SEQ ID NO: 154 | H-C-L1 | SEQ ID NO: 634 |
| AK104 | SEQ ID NO: 1 | SEQ ID NO: 770 | — | — | SEQ ID NO: 154 | H-C-L1 | SEQ ID NO: 635 |
| AK105 | SEQ ID NO: 1 | SEQ ID NO: 771 | — | — | SEQ ID NO: 154 | H-C-L1 | SEQ ID NO: 636 |
| AK106 | — | SEQ ID NO: 28 | SEQ ID NO: 261 | — | SEQ ID NO: 154 | H-L1-MM | SEQ ID NO: 637 |
| AK112 | SEQ ID NO: 1 | SEQ ID NO: 15 | SEQ ID NO: 261 | — | SEQ ID NO: 154 | H-C-L1-MM | SEQ ID NO: 602 |
| AK113 | SEQ ID NO: 3 | SEQ ID NO: 15 | SEQ ID NO: 261 | — | SEQ ID NO: 154 | H-C-L1-MM | SEQ ID NO: 642 |
| AK114 | SEQ ID NO: 6 | SEQ ID NO: 15 | SEQ ID NO: 261 | — | SEQ ID NO: 154 | H-C-L1-MM | SEQ ID NO: 643 |
| AK115 | — | SEQ ID NO: 28 | SEQ ID NO: 10 | — | SEQ ID NO: 155 | H-L1-MM | SEQ ID NO: 644 |
| AK116 | SEQ ID NO: 775 | — | — | — | SEQ ID NO: 154 | H-C | SEQ ID NO: 645 |
| AK117 | SEQ ID NO: 776 | — | — | — | SEQ ID NO: 154 | H-C | SEQ ID NO: 646 |
| AK118 | SEQ ID NO: 777 | — | — | — | SEQ ID NO: 154 | H-C | SEQ ID NO: 647 |
| AK119 | SEQ ID NO: 778 | — | — | — | SEQ ID NO: 154 | H-C | SEQ ID NO: 648 |
| AK120 | SEQ ID NO: 779 | — | — | — | SEQ ID NO: 154 | H-C | SEQ ID NO: 649 |
| AK121 | SEQ ID NO: 780 | — | — | — | SEQ ID NO: 154 | H-C | SEQ ID NO: 650 |
| AK122 | SEQ ID NO: 781 | — | — | — | SEQ ID NO: 154 | H-C | SEQ ID NO: 651 |
| AK123 | SEQ ID NO: 782 | — | — | — | SEQ ID NO: 154 | H-C | SEQ ID NO: 652 |
| AK124 | SEQ ID NO: 783 | — | — | — | SEQ ID NO: 154 | H-C | SEQ ID NO: 653 |
| AK125 | SEQ ID NO: 784 | — | — | — | SEQ ID NO: 154 | H-C | SEQ ID NO: 654 |
| AK126 | SEQ ID NO: 785 | — | — | — | SEQ ID NO: 154 | H-C | SEQ ID NO: 655 |
| AK127 | SEQ ID NO: 786 | — | — | — | SEQ ID NO: 154 | H-C | SEQ ID NO: 656 |
| AK128 | SEQ ID NO: 787 | — | — | — | SEQ ID NO: 154 | H-C | SEQ ID NO: 657 |
| AK129 | SEQ ID NO: 788 | — | — | — | SEQ ID NO: 154 | H-C | SEQ ID NO: 658 |
| AK130 | SEQ ID NO: 789 | — | — | — | SEQ ID NO: 154 | H-C | SEQ ID NO: 659 |
| AK131 | SEQ ID NO: 790 | — | — | — | SEQ ID NO: 154 | H-C | SEQ ID NO: 660 |

TABLE 4-continued

| Construct # | Cytokine or functional fragment thereof (C) | Linker (L1) | Masking moiety (MM) | Linker (L2) | Half-life extension domain (H) | Structure (N- to C-terminal direction) | Amino Acid Sequence |
|---|---|---|---|---|---|---|---|
| AK132 | SEQ ID NO: 791 | — | — | — | SEQ ID NO: 154 | H-C | SEQ ID NO: 661 |
| AK133 | SEQ ID NO: 792 | — | — | — | SEQ ID NO: 154 | H-C | SEQ ID NO: 662 |

Masked IL-15 polypeptide constructs are generated that include an IL-15 polypeptide or functional fragment thereof, a masking moiety, and a half-life extension domain, such as albumin, an antibody or fragment thereof (e.g., an Fc region, heavy chain, and/or light chain), an albumin-binding peptide, an IgG-binding peptide, or a polyamino acid sequence. Some IL-15 polypeptide constructs are also generated that include an IL-15 polypeptide or functional fragment thereof linked to a half-life extension domain without also including a masking moiety. Some of the constructs also include a linker that comprises a cleavable peptide and links the masking moiety to the IL-15 polypeptide or functional fragment thereof, thereby resulting in an activatable masked IL-15 polypeptide construct. Some of the constructs also include a linker that links the IL-15 polypeptide or functional fragment thereof to the half-life extension domain. Some of the constructs also include a linker that links the IL-15 polypeptide or functional fragment thereof to the masking moiety. The masked IL-15 polypeptide constructs that do not include a cleavable peptide in the linker that links the IL-15 polypeptide or functional fragment thereof to the masking moiety are also referred to as non-activatable masked IL-15 polypeptide constructs or non-activatable IL-15 polypeptide constructs because they do not include a cleavable peptide. Some IL-15 polypeptide constructs are also generated that include a masking moiety comprising the amino acid sequence of SEQ ID NO: 261. The structure and composition of exemplary IL-15 polypeptide constructs are provided in Table 5.

Also generated are masked IL-2 polypeptide constructs that include an IL-2 polypeptide or functional fragment thereof, a first masking moiety, a second masking moiety, and a half-life extension domain, such as albumin, an antibody or fragment thereof (e.g., an Fc region, heavy chain, and/or light chain), an albumin-binding peptide, an IgG-binding peptide, or a polyamino acid sequence. Some of the constructs also include a linker that links the first masking moiety to the IL-2 polypeptide or functional fragment thereof. Some of the constructs also include a linker that links the second masking moiety to the IL-2 polypeptide or functional fragment thereof. Some of the constructs include a cleavable peptide in the linker linking the first masking moiety to the IL-2 polypeptide or functional fragment thereof and/or the linker linking the second masking moiety to the IL-2 polypeptide or functional fragment thereof, thereby resulting in an activatable masked IL-2 polypeptide construct. Some of the constructs also include a linker linking the second masking moiety to the half-life extension domain. The masked IL-2 polypeptide constructs that do not include a cleavable peptide in either of the linkers that link the IL-2 polypeptide or functional fragment thereof to the first masking moiety or the second masking moiety are also referred to as non-activatable masked IL-2 polypeptide constructs or non-activatable IL-2 polypeptide constructs because they do not include a cleavable peptide. The structure and composition of exemplary IL-2 polypeptide constructs are provided in Table 6.

TABLE 5

| Construct # | Cytokine or functional fragment thereof (C) | Linker (L1) | Masking moiety (MM) | Linker (L2) | Half-life extension domain (H) | Structure (N- to C-terminal direction) |
|---|---|---|---|---|---|---|
| 3000 | SEQ ID NO: 167 | SEQ ID NO: 20 | SEQ ID NO: 10 | SEQ ID NO: 15 | SEQ ID NO: 154 | H-L1-MM-L2-C |
| 3001 | SEQ ID NO: 167 | SEQ ID NO: 20 | SEQ ID NO: 161 | SEQ ID NO: 16 | SEQ ID NO: 154 | H-L1-MM-L2-C |
| 3002 | SEQ ID NO: 167 | SEQ ID NO: 20 | SEQ ID NO: 162 | SEQ ID NO: 17 | SEQ ID NO: 154 | H-L1-MM-L2-C |
| 3003 | SEQ ID NO: 167 | SEQ ID NO: 20 | SEQ ID NO: 163 | SEQ ID NO: 18 | SEQ ID NO: 154 | H-L1-MM-L2-C |
| 3004 | SEQ ID NO: 167 | SEQ ID NO: 20 | SEQ ID NO: 164 | SEQ ID NO: 19 | SEQ ID NO: 154 | H-L1-MM-L2-C |
| 3005 | SEQ ID NO: 167 | SEQ ID NO: 20 | SEQ ID NO: 165 | SEQ ID NO: 15 | SEQ ID NO: 154 | H-L1-MM-L2-C |
| 3006 | SEQ ID NO: 167 | SEQ ID NO: 20 | SEQ ID NO: 219 | SEQ ID NO: 16 | SEQ ID NO: 154 | H-L1-MM-L2-C |
| 3007 | SEQ ID NO: 167 | SEQ ID NO: 20 | SEQ ID NO: 220 | SEQ ID NO: 17 | SEQ ID NO: 154 | H-L1-MM-L2-C |
| 3008 | SEQ ID NO: 167 | SEQ ID NO: 20 | SEQ ID NO: 221 | SEQ ID NO: 18 | SEQ ID NO: 154 | H-L1-MM-L2-C |
| 3009 | SEQ ID NO: 167 | SEQ ID NO: 20 | SEQ ID NO: 222 | SEQ ID NO: 19 | SEQ ID NO: 154 | H-L1-MM-L2-C |
| 3010 | SEQ ID NO: 167 | SEQ ID NO: 20 | SEQ ID NO: 223 | SEQ ID NO: 15 | SEQ ID NO: 154 | C-L2-MM-L1-H |
| 3011 | SEQ ID NO: 167 | SEQ ID NO: 20 | SEQ ID NO: 224 | SEQ ID NO: 16 | SEQ ID NO: 154 | C-L2-MM-L1-H |
| 3012 | SEQ ID NO: 167 | SEQ ID NO: 20 | SEQ ID NO: 225 | SEQ ID NO: 17 | SEQ ID NO: 154 | C-L2-MM-L1-H |
| 3013 | SEQ ID NO: 167 | SEQ ID NO: 20 | SEQ ID NO: 226 | SEQ ID NO: 18 | SEQ ID NO: 154 | C-L2-MM-L1-H |
| 3014 | SEQ ID NO: 167 | SEQ ID NO: 20 | SEQ ID NO: 227 | SEQ ID NO: 19 | SEQ ID NO: 154 | C-L2-MM-L1-H |
| 3015 | SEQ ID NO: 167 | SEQ ID NO: 20 | SEQ ID NO: 228 | SEQ ID NO: 15 | SEQ ID NO: 154 | C-L2-MM-L1-H |
| 3016 | SEQ ID NO: 167 | SEQ ID NO: 20 | SEQ ID NO: 229 | SEQ ID NO: 16 | SEQ ID NO: 154 | C-L2-MM-L1-H |
| 3017 | SEQ ID NO: 167 | SEQ ID NO: 20 | SEQ ID NO: 232 | SEQ ID NO: 17 | SEQ ID NO: 154 | C-L2-MM-L1-H |
| 3018 | SEQ ID NO: 167 | SEQ ID NO: 20 | SEQ ID NO: 233 | SEQ ID NO: 18 | SEQ ID NO: 154 | C-L2-MM-L1-H |
| 3019 | SEQ ID NO: 167 | SEQ ID NO: 20 | SEQ ID NO: 234 | SEQ ID NO: 19 | SEQ ID NO: 154 | C-L2-MM-L1-H |

TABLE 6

| Construct # | Masking moiety (MM1) | Linker (L1) | Cytokine or functional fragment thereof (C) | Linker (L2) | Masking moiety (MM2) | Linker (L3) | Half-life extension domain (H) | Structure (N- to C- terminal direction) | Amino Acid Sequence |
|---|---|---|---|---|---|---|---|---|---|
| 2015 | SEQ ID NO: 9 | SEQ ID NO: 20 | SEQ ID NO: 1 | SEQ ID NO: 29 | SEQ ID NO: 10 | SEQ ID NO: 15 | SEQ ID NO: 154 | H-L1-MM1-L2-C-L3-MM2 | |
| 2072 | SEQ ID NO: 9 | SEQ ID NO: 20 | SEQ ID NO: 1 | SEQ ID NO: 29 | SEQ ID NO: 10 | SEQ ID NO: 16 | SEQ ID NO: 154 | H-L1-MM1-L2-C-L3-MM2 | |
| 2073 | SEQ ID NO: 9 | SEQ ID NO: 20 | SEQ ID NO: 1 | SEQ ID NO: 29 | SEQ ID NO: 10 | SEQ ID NO: 17 | SEQ ID NO: 154 | H-L1-MM1-L2-C-L3-MM2 | |
| 2074 | SEQ ID NO: 9 | SEQ ID NO: 20 | SEQ ID NO: 1 | SEQ ID NO: 29 | SEQ ID NO: 10 | SEQ ID NO: 18 | SEQ ID NO: 154 | H-L1-MM1-L2-C-L3-MM2 | |
| 2075 | SEQ ID NO: 9 | SEQ ID NO: 20 | SEQ ID NO: 1 | SEQ ID NO: 29 | SEQ ID NO: 10 | SEQ ID NO: 19 | SEQ ID NO: 154 | H-L1-MM1-L2-C-L3-MM2 | |
| 2076 | SEQ ID NO: 9 | SEQ ID NO: 20 | SEQ ID NO: 2 | SEQ ID NO: 29 | SEQ ID NO: 10 | SEQ ID NO: 16 | SEQ ID NO: 154 | H-L1-MM1-L2-C-L3-MM2 | |
| 2077 | SEQ ID NO: 9 | SEQ ID NO: 20 | SEQ ID NO: 2 | SEQ ID NO: 29 | SEQ ID NO: 10 | SEQ ID NO: 17 | SEQ ID NO: 154 | H-L1-MM1-L2-C-L3-MM2 | |
| 2078 | SEQ ID NO: 9 | SEQ ID NO: 20 | SEQ ID NO: 2 | SEQ ID NO: 29 | SEQ ID NO: 10 | SEQ ID NO: 18 | SEQ ID NO: 154 | H-L1-MM1-L2-C-L3-MM2 | |
| 2079 | SEQ ID NO: 9 | SEQ ID NO: 20 | SEQ ID NO: 2 | SEQ ID NO: 29 | SEQ ID NO: 10 | SEQ ID NO: 19 | SEQ ID NO: 154 | H-L1-MM1-L2-C-L3-MM2 | |
| AK041 | SEQ ID NO: 9 | SEQ ID NO: 20 | SEQ ID NO: 1 | SEQ ID NO: 29 | SEQ ID NO: 10 | SEQ ID NO: 15 | SEQ ID NO: 154 | H-L1-MM1-L2-C-L3-MM2 | SEQ ID NO: 567 |
| AK072 | SEQ ID NO: 9 | SEQ ID NO: 20 | SEQ ID NO: 1 | SEQ ID NO: 29 | SEQ ID NO: 10 | SEQ ID NO: 16 | SEQ ID NO: 154 | H-L1-MM1-L2-C-L3-MM2 | SEQ ID NO: 598 |
| AK073 | SEQ ID NO: 9 | SEQ ID NO: 20 | SEQ ID NO: 1 | SEQ ID NO: 29 | SEQ ID NO: 10 | SEQ ID NO: 17 | SEQ ID NO: 154 | H-L1-MM1-L2-C-L3-MM2 | SEQ ID NO: 599 |
| AK074 | SEQ ID NO: 9 | SEQ ID NO: 20 | SEQ ID NO: 1 | SEQ ID NO: 29 | SEQ ID NO: 10 | SEQ ID NO: 18 | SEQ ID NO: 154 | H-L1-MM1-L2-C-L3-MM2 | SEQ ID NO: 600 |
| AK075 | SEQ ID NO: 9 | SEQ ID NO: 20 | SEQ ID NO: 1 | SEQ ID NO: 29 | SEQ ID NO: 10 | SEQ ID NO: 19 | SEQ ID NO: 154 | H-L1-MM1-L2-C-L3-MM2 | SEQ ID NO: 601 |

Also generated are masked IL-15 polypeptide constructs that include an IL-15 polypeptide or functional fragment thereof, a first masking moiety, a second masking moiety, and a half-life extension domain, such as albumin, an antibody or fragment thereof (e.g., an Fc region, heavy chain, and/or light chain), an albumin-binding peptide, an IgG-binding peptide, or a polyamino acid sequence. Some of the constructs also include a linker that links the first masking moiety to the IL-15 polypeptide or functional fragment thereof. Some of the constructs also include a linker that links the second masking moiety to the IL-15 polypeptide or functional fragment thereof. Some of the constructs include a cleavable peptide in the linker linking the first masking moiety to the IL-15 polypeptide or functional fragment thereof and/or the linker linking the second masking moiety to the IL-15 polypeptide or functional fragment thereof, thereby resulting in an activatable masked IL-15 polypeptide construct. Some of the constructs also include a linker linking the second masking moiety to the half-life extension domain. Some of the constructs also include a second half-life extension domain that associates with the first half-life extension domain. The masked IL-15 polypeptide constructs that do not include a cleavable peptide in either of the linkers that link the IL-15 polypeptide or functional fragment thereof to the first masking moiety or the second masking moiety are also referred to as non-activatable masked IL-15 polypeptide constructs or non-activatable IL-2 polypeptide constructs because they do not include a cleavable peptide. The structure and composition of exemplary IL-15 polypeptide constructs are provided in Table 7.

TABLE 7

| Construct # | Masking moiety (MM1) | Linker (L1) | Cytokine or functional fragment thereof (C) | Linker (L2) | Masking moiety (MM2) | Linker (L3) | Half-life extension domain (H) | Structure (N- to C- terminal direction) | Amino Acid Sequence |
|---|---|---|---|---|---|---|---|---|---|
| 3020 | SEQ ID NO: 232 | SEQ ID NO: 20 | SEQ ID NO: 167 | SEQ ID NO: 29 | SEQ ID NO: 10 | SEQ ID NO: 15 | SEQ ID NO: 154 | H-L1 -MM1-L2-C-L3 -MM2 | |
| 3021 | SEQ ID NO: 232 | SEQ ID NO: 20 | SEQ ID NO: 167 | SEQ ID NO: 29 | SEQ ID NO: 161 | SEQ ID NO: 16 | SEQ ID NO: 154 | H-L1 -MM1-L2-C-L3 -MM2 | |
| 3022 | SEQ ID NO: 232 | SEQ ID NO: 20 | SEQ ID NO: 167 | SEQ ID NO: 29 | SEQ ID NO: 162 | SEQ ID NO: 17 | SEQ ID NO: 154 | H-L1 -MM1-L2-C-L3 -MM2 | |
| 3023 | SEQ ID NO: 232 | SEQ ID NO: 20 | SEQ ID NO: 167 | SEQ ID NO: 29 | SEQ ID NO: 163 | SEQ ID NO: 18 | SEQ ID NO: 154 | H-L1 -MM1-L2-C-L3 -MM2 | |
| 3024 | SEQ ID NO: 233 | SEQ ID NO: 20 | SEQ ID NO: 167 | SEQ ID NO: 29 | SEQ ID NO: 164 | SEQ ID NO: 19 | SEQ ID NO: 154 | H-L1 -MM1-L2-C-L3 -MM2 | |
| 3025 | SEQ ID NO: 233 | SEQ ID NO: 20 | SEQ ID NO: 167 | SEQ ID NO: 29 | SEQ ID NO: 165 | SEQ ID NO: 15 | SEQ ID NO: 154 | H-L1 -MM1-L2-C-L3 -MM2 | |
| 3026 | SEQ ID NO: 233 | SEQ ID NO: 20 | SEQ ID NO: 167 | SEQ ID NO: 29 | SEQ ID NO: 219 | SEQ ID NO: 16 | SEQ ID NO: 154 | H-L1 -MM1-L2-C-L3 -MM2 | |
| 3027 | SEQ ID NO: 233 | SEQ ID NO: 20 | SEQ ID NO: 167 | SEQ ID NO: 29 | SEQ ID NO: 220 | SEQ ID NO: 17 | SEQ ID NO: 154 | H-L1 -MM1-L2-C-L3 -MM2 | |

TABLE 7-continued

| Construct # | Masking moiety (MM1) | Linker (L1) | Cytokine or functional fragment thereof (C) | Linker (L2) | Masking moiety (MM2) | Linker (L3) | Half-life extension domain (H) | Structure (N- to C- terminal direction) | Amino Acid Sequence |
|---|---|---|---|---|---|---|---|---|---|
| 3028 | SEQ ID NO: 234 | SEQ ID NO: 20 | SEQ ID NO: 167 | SEQ ID NO: 29 | SEQ ID NO: 221 | SEQ ID NO: 18 | SEQ ID NO: 154 | H-L1-MM1-L2-C-L3-MM2 | |
| 3029 | SEQ ID NO: 234 | SEQ ID NO: 20 | SEQ ID NO: 167 | SEQ ID NO: 29 | SEQ ID NO: 222 | SEQ ID NO: 19 | SEQ ID NO: 154 | H-L1-MM1-L2-C-L3-MM2 | |
| 3030 | SEQ ID NO: 234 | SEQ ID NO: 20 | SEQ ID NO: 167 | SEQ ID NO: 29 | SEQ ID NO: 227 | SEQ ID NO: 15 | SEQ ID NO: 154 | MM2-L3-C-L2-MM1-L1-H | |
| 3031 | SEQ ID NO: 234 | SEQ ID NO: 20 | SEQ ID NO: 167 | SEQ ID NO: 29 | SEQ ID NO: 228 | SEQ ID NO: 16 | SEQ ID NO: 154 | MM2-L3-C-L2-MM1-L1-H | |
| 3032 | SEQ ID NO: 234 | SEQ ID NO: 20 | SEQ ID NO: 167 | SEQ ID NO: 29 | SEQ ID NO: 229 | SEQ ID NO: 17 | SEQ ID NO: 154 | MM2-L3-C-L2-MM1-L1-H | |
| AK401 | SEQ ID NO: 261 | SEQ ID NO: 28 | SEQ ID NO: 167 | SEQ ID NO: 318 | SEQ ID NO: 825 | SEQ ID NO: 27 | SEQ ID NO: 155 | H-L1-MM1-L2-MM2-L3-C | SEQ ID NO: 755 |
|  | — | — | — | — | — | — | SEQ ID NO: 616 | H | SEQ ID NO: 616 |
| AK403 | SEQ ID NO: 261 | SEQ ID NO: 28 | SEQ ID NO: 167 | SEQ ID NO: 318 | SEQ ID NO: 825 | SEQ ID NO: 27 | SEQ ID NO: 155 | H-L1-MM1-L2-MM2-L3-C | SEQ ID NO: 756 |
|  | — | — | — | — | — | — | SEQ ID NO: 616 | H | SEQ ID NO: 616 |
| AK402 | SEQ ID NO: 261 | SEQ ID NO: 28 | SEQ ID NO: 167 | SEQ ID NO: 319 | SEQ ID NO: 825 | SEQ ID NO: 27 | SEQ ID NO: 155 | H-L1-MM1-L2-MM2-L3-C | SEQ ID NO: 757 |
|  | — | — | — | — | — | — | SEQ ID NO: 616 | H | SEQ ID NO: 616 |

Also generated are masked IL-2 polypeptide constructs that include an IL-2 polypeptide or functional fragment thereof, a masking moiety, a first half-life extension domain, and a second half-life extension domain, such as albumin, an antibody or fragment thereof (e.g., an Fc region, heavy chain, and/or light chain), an albumin-binding peptide, an IgG-binding peptide, or a polyamino acid sequence. The masking moiety is linked to the first half-life extension domain, the IL-2 polypeptide or functional fragment thereof is linked to the second half-life extension domain, and the first half-life extension domain and the second half-life extension domain contain modifications promoting the association of the first and the second half-life extension domain. In one exemplary embodiment, the masking moiety is linked to the first half-life extension domain and includes the amino acid sequence of SEQ ID NO: 267, and the IL-2 polypeptide or functional fragment thereof is linked to the second half-life extension domain and includes the amino acid sequence of SEQ ID NO: 266, and the first half-life extension domain and the second half-life extension domain contain modifications promoting the association of the first and the second half-life extension domain. In one exemplary embodiment of a non-masked IL-2 polypeptide construct, the embodiment comprises an IL-2 polypeptide or functional fragment thereof linked to a first half-life extension domain, and comprises a second half-life extension domain, where the IL-2 polypeptide or functional fragment thereof is linked to the first half-life extension domain and includes the amino acid sequence of SEQ ID NO: 266, and the second half-life extension domain includes the amino acid sequence of SEQ ID NO: 265. Some of the constructs also include a linker that links the masking moiety to the first half-life extension domain, and/or a linker that links the IL-2 polypeptide or functional fragment thereof to the second half-life extension domain. The first and second half-life extension domain of some of the constructs are also linked. In some constructs, the first and second half-life extension domain of some of the constructs are linked by a linker. Some of the constructs include a cleavable peptide in the linker linking the masking moiety to the first half-life extension domain and/or the linker linking the IL-2 polypeptide or functional fragment thereof to the second half-life extension domain, thereby resulting in an activatable masked IL-2 polypeptide construct. The masked IL-2 polypeptide constructs that do not include a cleavable peptide in either the linker that links the IL-2 polypeptide or functional fragment thereof to the second half-life extension domain or the linker that links the masking moiety to the first half-life extension domain are also referred to as non-activatable masked IL-2 polypeptide constructs or non-activatable IL-2 polypeptide constructs because they do not include a cleavable peptide. The structure and composition of exemplary IL-2 polypeptide constructs are provided in Table 8.

TABLE 8

| Construct # | Cytokine or functional fragment thereof (C) | Linker (L1) | Masking moiety (MM) | Linker (L2) | Half-life extension domain (H) | Structure (N- to C-terminal direction) | Amino Acid Sequence |
|---|---|---|---|---|---|---|---|
| 2007/2008 | SEQ ID NO: 1 | SEQ ID NO: 22 | — | — | SEQ ID NO: 157 | C-L1-H | |
|  | — | SEQ ID NO: 23 | SEQ ID NO: 9 | — | SEQ ID NO: 158 | MM-L1-H | |
| 2009/2010 | — | SEQ ID NO: 24 | SEQ ID NO: 9 | — | SEQ ID NO: 158 | MM-L1-H | |
|  | SEQ ID NO: 1 | SEQ ID NO: 25 | — | — | SEQ ID NO: 157 | C-L1-H | |
| 2080/2081 | — | SEQ ID NO: 28 | SEQ ID NO: 10 | — | SEQ ID NO: 155 | H-L1-MM | |
|  | SEQ ID NO: 1 | SEQ ID NO: 11 | — | — | SEQ ID NO: 156 | H-L1-C | |
| 2080/2082 | — | SEQ ID NO: 28 | SEQ ID NO: 10 | — | SEQ ID NO: 155 | H-L1-MM | |
|  | SEQ ID NO: 1 | SEQ ID NO: 12 | — | — | SEQ ID NO: 156 | H-L1-C | |
| 2080/2083 | — | SEQ ID NO: 28 | SEQ ID NO: 10 | — | SEQ ID NO: 155 | H-L1-MM | |
|  | SEQ ID NO: 1 | SEQ ID NO: 13 | — | — | SEQ ID NO: 156 | H-L1-C | |

TABLE 8-continued

| Construct # | Cytokine or functional fragment thereof (C) | Linker (L1) | Masking moiety (MM) | Linker (L2) | Half-life extension domain (H) | Structure (N- to C-terminal direction) | Amino Acid Sequence |
|---|---|---|---|---|---|---|---|
| 2080/2084 | — | SEQ ID NO: 28 | SEQ ID NO: 10 | — | SEQ ID NO: 155 | H-L1-MM | |
| | SEQ ID NO: 1 | SEQ ID NO: 14 | — | — | SEQ ID NO: 156 | H-L1-C | |
| 2080/2085 | — | SEQ ID NO: 28 | SEQ ID NO: 10 | — | SEQ ID NO: 155 | H-L1-MM | |
| | SEQ ID NO: 3 | SEQ ID NO: 11 | — | — | SEQ ID NO: 156 | H-L1-C | |
| 2080/2086 | — | SEQ ID NO: 28 | SEQ ID NO: 10 | — | SEQ ID NO: 155 | H-L1-MM | |
| | SEQ ID NO: 3 | SEQ ID NO: 12 | — | — | SEQ ID NO: 156 | H-L1-C | |
| 2080/2087 | — | SEQ ID NO: 28 | SEQ ID NO: 10 | — | SEQ ID NO: 155 | H-L1-MM | |
| | SEQ ID NO: 3 | SEQ ID NO: 13 | — | — | SEQ ID NO: 156 | H-L1-C | |
| 2080/2088 | — | SEQ ID NO: 28 | SEQ ID NO: 10 | — | SEQ ID NO: 155 | H-L1-MM | |
| | SEQ ID NO: 3 | SEQ ID NO: 14 | — | — | SEQ ID NO: 156 | H-L1-C | |
| 2080/2089 | — | SEQ ID NO: 28 | SEQ ID NO: 10 | — | SEQ ID NO: 155 | H-L1-MM | |
| | SEQ ID NO: 4 | SEQ ID NO: 11 | — | — | SEQ ID NO: 156 | H-L1-C | |
| 2080/2090 | — | SEQ ID NO: 28 | SEQ ID NO: 10 | — | SEQ ID NO: 155 | H-L1-MM | |
| | SEQ ID NO: 4 | SEQ ID NO: 12 | — | — | SEQ ID NO: 156 | H-L1-C | |
| 2080/2091 | — | SEQ ID NO: 28 | SEQ ID NO: 10 | — | SEQ ID NO: 155 | H-L1-MM | |
| | SEQ ID NO: 4 | SEQ ID NO: 13 | — | — | SEQ ID NO: 156 | H-L1-C | |
| 2080/2092 | — | SEQ ID NO: 28 | SEQ ID NO: 10 | — | SEQ ID NO: 155 | H-L1-MM | |
| | SEQ ID NO: 4 | SEQ ID NO: 14 | — | — | SEQ ID NO: 156 | H-L1-C | |
| 2080/2093 | — | SEQ ID NO: 28 | SEQ ID NO: 10 | — | SEQ ID NO: 155 | H-L1-MM | |
| | SEQ ID NO: 5 | SEQ ID NO: 11 | — | — | SEQ ID NO: 156 | H-L1-C | |
| 2080/2094 | — | SEQ ID NO: 28 | SEQ ID NO: 10 | — | SEQ ID NO: 155 | H-L1-MM | |
| | SEQ ID NO: 5 | SEQ ID NO: 12 | — | — | SEQ ID NO: 156 | H-L1-C | |
| 2080/2095 | — | SEQ ID NO: 28 | SEQ ID NO: 10 | — | SEQ ID NO: 155 | H-L1-MM | |
| | SEQ ID NO: 5 | SEQ ID NO: 13 | — | — | SEQ ID NO: 156 | H-L1-C | |
| 2080/2096 | — | SEQ ID NO: 28 | SEQ ID NO: 10 | — | SEQ ID NO: 155 | H-L1-MM | |
| | SEQ ID NO: 5 | SEQ ID NO: 14 | — | — | SEQ ID NO: 156 | H-L1-C | |
| 2080/2097 | — | SEQ ID NO: 28 | SEQ ID NO: 10 | — | SEQ ID NO: 155 | H-L1-MM | |
| | SEQ ID NO: 6 | SEQ ID NO: 11 | — | — | SEQ ID NO: 156 | H-L1-C | |
| 2080/2098 | — | SEQ ID NO: 28 | SEQ ID NO: 10 | — | SEQ ID NO: 155 | H-L1-MM | |
| | SEQ ID NO: 6 | SEQ ID NO: 12 | — | — | SEQ ID NO: 156 | H-L1-C | |
| 2080/2099 | — | SEQ ID NO: 28 | SEQ ID NO: 10 | — | SEQ ID NO: 155 | H-L1-MM | |
| | SEQ ID NO: 6 | SEQ ID NO: 13 | — | — | SEQ ID NO: 156 | H-L1-C | |
| 2080/2100 | — | SEQ ID NO: 28 | SEQ ID NO: 10 | — | SEQ ID NO: 155 | H-L1-MM | |
| | SEQ ID NO: 6 | SEQ ID NO: 14 | — | — | SEQ ID NO: 156 | H-L1-C | |
| 2080/2101 | — | SEQ ID NO: 28 | SEQ ID NO: 10 | — | SEQ ID NO: 155 | H-L1-MM | |
| | SEQ ID NO: 7 | SEQ ID NO: 11 | — | — | SEQ ID NO: 156 | H-L1-C | |
| 2080/2102 | — | SEQ ID NO: 28 | SEQ ID NO: 10 | — | SEQ ID NO: 155 | H-L1-MM | |
| | SEQ ID NO: 7 | SEQ ID NO: 12 | — | — | SEQ ID NO: 156 | H-L1-C | |
| 2080/2103 | — | SEQ ID NO: 28 | SEQ ID NO: 10 | — | SEQ ID NO: 155 | H-L1-MM | |
| | SEQ ID NO: 7 | SEQ ID NO: 13 | — | — | SEQ ID NO: 156 | H-L1-C | |
| 2080/2104 | — | SEQ ID NO: 28 | SEQ ID NO: 10 | — | SEQ ID NO: 155 | H-L1-MM | |
| | SEQ ID NO: 7 | SEQ ID NO: 14 | — | — | SEQ ID NO: 156 | H-L1-C | |
| 2080/2105 | — | SEQ ID NO: 28 | SEQ ID NO: 10 | — | SEQ ID NO: 155 | H-L1-MM | |
| | SEQ ID NO: 8 | SEQ ID NO: 11 | — | — | SEQ ID NO: 156 | H-L1-C | |
| 2080/2106 | — | SEQ ID NO: 28 | SEQ ID NO: 10 | — | SEQ ID NO: 155 | H-L1-MM | |
| | SEQ ID NO: 8 | SEQ ID NO: 12 | — | — | SEQ ID NO: 156 | H-L1-C | |
| 2080/2107 | — | SEQ ID NO: 28 | SEQ ID NO: 10 | — | SEQ ID NO: 155 | H-L1-MM | |
| | SEQ ID NO: 8 | SEQ ID NO: 13 | — | — | SEQ ID NO: 156 | H-L1-C | |
| 2080/2108 | — | SEQ ID NO: 28 | SEQ ID NO: 10 | — | SEQ ID NO: 155 | H-L1-MM | |
| | SEQ ID NO: 8 | SEQ ID NO: 14 | — | — | SEQ ID NO: 156 | H-L1-C | |
| 5001/5002 | SEQ ID NO: 260 | SEQ ID NO: 262 | — | — | SEQ ID NO: 156 | H-L1-C | SEQ ID NO: 266 |
| | — | — | — | — | SEQ ID NO: 265 | H | SEQ ID NO: 265 |
| 5001/5003 | SEQ ID NO: 260 | SEQ ID NO: 262 | — | — | SEQ ID NO: 156 | H-L1-C | SEQ ID NO: 266 |
| | — | SEQ ID NO: 28 | SEQ ID NO: 261 | — | SEQ ID NO: 155 | H-L1-MM | SEQ ID NO: 267 |
| AK038 | SEQ ID NO: 1 | SEQ ID NO: 22 | — | — | SEQ ID NO: 157 | C-L1-H | SEQ ID NO: 562 |
| | — | SEQ ID NO: 23 | SEQ ID NO: 9 | — | SEQ ID NO: 158 | MM-L1-H | SEQ ID NO: 563 |
| AK039 | — | SEQ ID NO: 24 | SEQ ID NO: 9 | — | SEQ ID NO: 158 | MM-L1-H | SEQ ID NO: 564 |
| | SEQ ID NO: 1 | SEQ ID NO: 25 | — | — | SEQ ID NO: 157 | C-L1-H | SEQ ID NO: 565 |
| AK076 | SEQ ID NO: 1 | SEQ ID NO: 11 | — | — | SEQ ID NO: 156 | H-L1-C | SEQ ID NO: 608 |
| | — | SEQ ID NO: 795 | SEQ ID NO: 10 | — | SEQ ID NO: 155 | H-L1-MM | SEQ ID NO: 603 |
| AK077 | SEQ ID NO: 1 | SEQ ID NO: 12 | — | — | SEQ ID NO: 156 | H-L1-C | SEQ ID NO: 604 |
| | — | SEQ ID NO: 795 | SEQ ID NO: 10 | — | SEQ ID NO: 155 | H-L1-MM | SEQ ID NO: 603 |
| AK078 | SEQ ID NO: 1 | SEQ ID NO: 13 | — | — | SEQ ID NO: 156 | H-L1-C | SEQ ID NO: 605 |
| | — | SEQ ID NO: 795 | SEQ ID NO: 10 | — | SEQ ID NO: 155 | H-L1-MM | SEQ ID NO: 603 |
| AK079 | SEQ ID NO: 1 | SEQ ID NO: 14 | — | — | SEQ ID NO: 156 | H-L1-C | SEQ ID NO: 606 |
| | — | SEQ ID NO: 795 | SEQ ID NO: 10 | — | SEQ ID NO: 155 | H-L1-MM | SEQ ID NO: 603 |
| AK081 | SEQ ID NO: 1 | SEQ ID NO: 11 | — | — | SEQ ID NO: 156 | H-L1-C | SEQ ID NO: 608 |
| | — | — | — | — | SEQ ID NO: 265 | H | SEQ ID NO: 265 |
| AK088 | SEQ ID NO: 1 | — | — | — | SEQ ID NO: 155 | H-C | SEQ ID NO: 615 |
| | — | — | — | — | SEQ ID NO: 616 | H | SEQ ID NO: 616 |
| AK089 | SEQ ID NO: 1 | — | — | — | SEQ ID NO: 155 | H-C | SEQ ID NO: 615 |
| | — | SEQ ID NO: 15 | SEQ ID NO: 10 | — | SEQ ID NO: 156 | H-L1-MM | SEQ ID NO: 617 |
| AK090 | SEQ ID NO: 1 | — | — | — | SEQ ID NO: 721 | H-C | SEQ ID NO: 618 |
| | — | — | — | — | SEQ ID NO: 619 | H | SEQ ID NO: 619 |
| AK091 | SEQ ID NO: 1 | — | — | — | SEQ ID NO: 721 | H-C | SEQ ID NO: 618 |
| | — | SEQ ID NO: 15 | SEQ ID NO: 10 | — | SEQ ID NO: 772 | H-L1-MM | SEQ ID NO: 620 |

TABLE 8-continued

| Construct # | Cytokine or functional fragment thereof (C) | Linker (L1) | Masking moiety (MM) | Linker (L2) | Half-life extension domain (H) | Structure (N- to C-terminal direction) | Amino Acid Sequence |
|---|---|---|---|---|---|---|---|
| AK092 | SEQ ID NO: 1 | — | — | — | SEQ ID NO: 793 | H-C | SEQ ID NO: 621 |
|  | — | — | — | — | SEQ ID NO: 622 | H | SEQ ID NO: 622 |
| AK093 | SEQ ID NO: 1 | — | — | — | SEQ ID NO: 793 | H-C | SEQ ID NO: 621 |
|  | — | SEQ ID NO: 15 | SEQ ID NO: 10 | — | SEQ ID NO: 773 | H-L1-MM | SEQ ID NO: 623 |
| AK094 | SEQ ID NO: 1 | — | — | — | SEQ ID NO: 796 | H-C | SEQ ID NO: 624 |
|  | — | — | — | — | SEQ ID NO: 625 | H | SEQ ID NO: 625 |
| AK095 | SEQ ID NO: 1 | — | — | — | SEQ ID NO: 796 | H-C | SEQ ID NO: 624 |
|  | — | SEQ ID NO: 15 | SEQ ID NO: 10 | — | SEQ ID NO: 774 | H-L1-MM | SEQ ID NO: 626 |
| AK107 | — | SEQ ID NO: 15 | SEQ ID NO: 261 | — | SEQ ID NO: 156 | H-L1-MM | SEQ ID NO: 638 |
|  | SEQ ID NO: 1 | — | — | — | SEQ ID NO: 155 | H-C | SEQ ID NO: 615 |
| AK108 | — | SEQ ID NO: 15 | SEQ ID NO: 261 | — | SEQ ID NO: 772 | H-L1-MM | SEQ ID NO: 639 |
|  | SEQ ID NO: 1 | — | — | — | SEQ ID NO: 721 | H-C | SEQ ID NO: 618 |
| AK109 | — | SEQ ID NO: 15 | SEQ ID NO: 261 | — | SEQ ID NO: 773 | H-L1-MM | SEQ ID NO: 640 |
|  | SEQ ID NO: 1 | — | — | — | SEQ ID NO: 793 | H-C | SEQ ID NO: 621 |
| AK110 | — | SEQ ID NO: 15 | SEQ ID NO: 261 | — | SEQ ID NO: 774 | H-L1-MM | SEQ ID NO: 641 |
|  | SEQ ID NO: 1 | — | — | — | SEQ ID NO: 796 | H-C | SEQ ID NO: 624 |
| AK111 | SEQ ID NO: 1 | SEQ ID NO: 11 | — | — | SEQ ID NO: 156 | H-L1-C | SEQ ID NO: 608 |
|  | — | SEQ ID NO: 28 | SEQ ID NO: 261 | — | SEQ ID NO: 155 | H-L1-MM | SEQ ID NO: 267 |
| AK163 | SEQ ID NO: 1 | SEQ ID NO: 11 | — | — | SEQ ID NO: 793 | H-L1-C | SEQ ID NO: 663 |
|  | — | — | — | — | SEQ ID NO: 622 | H | SEQ ID NO: 622 |
| AK164 | SEQ ID NO: 1 | SEQ ID NO: 11 | — | — | SEQ ID NO: 793 | H-L1-C | SEQ ID NO: 663 |
|  | — | SEQ ID NO: 795 | SEQ ID NO: 261 | — | SEQ ID NO: 773 | H-L1-MM | SEQ ID NO: 664 |
| AK165 | SEQ ID NO: 1 | SEQ ID NO: 11 | — | — | SEQ ID NO: 796 | H-L1-C | SEQ ID NO: 665 |
|  | — | — | — | — | SEQ ID NO: 625 | H | SEQ ID NO: 625 |
| AK166 | SEQ ID NO: 1 | SEQ ID NO: 11 | — | — | SEQ ID NO: 796 | H-L1-C | SEQ ID NO: 665 |
|  | — | SEQ ID NO: 795 | SEQ ID NO: 261 | — | SEQ ID NO: 774 | H-L1-MM | SEQ ID NO: 666 |
| AK167 | SEQ ID NO: 3 | SEQ ID NO: 11 | — | — | SEQ ID NO: 156 | H-L1-C | SEQ ID NO: 667 |
|  | — | — | — | — | SEQ ID NO: 265 | H | SEQ ID NO: 265 |
| AK168 | SEQ ID NO: 3 | SEQ ID NO: 11 | — | — | SEQ ID NO: 156 | H-L1-C | SEQ ID NO: 667 |
|  | — | SEQ ID NO: 28 | SEQ ID NO: 261 | — | SEQ ID NO: 155 | H-L1-MM | SEQ ID NO: 267 |
| AK169 | SEQ ID NO: 6 | SEQ ID NO: 11 | — | — | SEQ ID NO: 156 | H-L1-C | SEQ ID NO: 669 |
|  | — | — | — | — | SEQ ID NO: 265 | H | SEQ ID NO: 265 |
| AK170 | — | SEQ ID NO: 28 | SEQ ID NO: 261 | — | SEQ ID NO: 155 | H-L1-MM | SEQ ID NO: 267 |
|  | SEQ ID NO: 6 | SEQ ID NO: 11 | — | — | SEQ ID NO: 156 | H-L1-C | SEQ ID NO: 669 |
| AK171 | SEQ ID NO: 1 | SEQ ID NO: 11 | — | — | SEQ ID NO: 155 | H-L1-C | SEQ ID NO: 670 |
|  | — | — | — | — | SEQ ID NO: 616 | H | SEQ ID NO: 616 |
| AK172 | SEQ ID NO: 1 | SEQ ID NO: 11 | — | — | SEQ ID NO: 155 | H-L1-C | SEQ ID NO: 670 |
|  | — | SEQ ID NO: 795 | SEQ ID NO: 261 | — | SEQ ID NO: 156 | H-L1-MM | SEQ ID NO: 671 |
| AK184 | SEQ ID NO: 1 | SEQ ID NO: 800 | — | — | SEQ ID NO: 156 | H-L1-C | SEQ ID NO: 672 |
|  | — | SEQ ID NO: 28 | SEQ ID NO: 261 | — | SEQ ID NO: 155 | H-L1-MM | SEQ ID NO: 267 |
| AK185 | SEQ ID NO: 1 | SEQ ID NO: 185 | — | — | SEQ ID NO: 156 | H-L1-C | SEQ ID NO: 673 |
|  | — | SEQ ID NO: 28 | SEQ ID NO: 261 | — | SEQ ID NO: 155 | H-L1-MM | SEQ ID NO: 267 |
| AK186 | SEQ ID NO: 1 | SEQ ID NO: 802 | — | — | SEQ ID NO: 156 | H-L1-C | SEQ ID NO: 674 |
|  | — | SEQ ID NO: 28 | SEQ ID NO: 261 | — | SEQ ID NO: 155 | H-L1-MM | SEQ ID NO: 267 |
| AK187 | SEQ ID NO: 1 | SEQ ID NO: 803 | — | — | SEQ ID NO: 156 | H-L1-C | SEQ ID NO: 675 |
|  | — | SEQ ID NO: 28 | SEQ ID NO: 261 | — | SEQ ID NO: 155 | H-L1-MM | SEQ ID NO: 267 |
| AK188 | SEQ ID NO: 3 | SEQ ID NO: 804 | — | — | SEQ ID NO: 156 | H-L1-C | SEQ ID NO: 676 |
|  | — | SEQ ID NO: 28 | SEQ ID NO: 261 | — | SEQ ID NO: 155 | H-L1-MM | SEQ ID NO: 267 |
| AK189 | SEQ ID NO: 1 | SEQ ID NO: 805 | — | — | SEQ ID NO: 156 | H-L1-C | SEQ ID NO: 677 |
|  | — | SEQ ID NO: 28 | SEQ ID NO: 261 | — | SEQ ID NO: 155 | H-L1-MM | SEQ ID NO: 267 |
| AK190 | SEQ ID NO: 1 | SEQ ID NO: 806 | — | — | SEQ ID NO: 156 | H-L1-C | SEQ ID NO: 678 |
|  | — | SEQ ID NO: 28 | SEQ ID NO: 261 | — | SEQ ID NO: 155 | H-L1-MM | SEQ ID NO: 267 |
| AK191 | SEQ ID NO: 3 | SEQ ID NO: 807 | — | — | SEQ ID NO: 156 | H-L1-C | SEQ ID NO: 679 |
|  | — | SEQ ID NO: 28 | SEQ ID NO: 261 | — | SEQ ID NO: 155 | H-L1-MM | SEQ ID NO: 267 |
| AK192 | SEQ ID NO: 3 | SEQ ID NO: 805 | — | — | SEQ ID NO: 156 | H-L1-C | SEQ ID NO: 680 |
|  | — | SEQ ID NO: 28 | SEQ ID NO: 261 | — | SEQ ID NO: 155 | H-L1-MM | SEQ ID NO: 267 |
| AK193 | SEQ ID NO: 3 | SEQ ID NO: 806 | — | — | SEQ ID NO: 156 | H-L1-C | SEQ ID NO: 681 |
|  | — | SEQ ID NO: 28 | SEQ ID NO: 261 | — | SEQ ID NO: 155 | H-L1-MM | SEQ ID NO: 267 |
| AK194 | SEQ ID NO: 1 | SEQ ID NO: 808 | — | — | SEQ ID NO: 156 | H-L1-C | SEQ ID NO: 682 |
|  | — | SEQ ID NO: 28 | SEQ ID NO: 261 | — | SEQ ID NO: 155 | H-L1-MM | SEQ ID NO: 267 |
| AK195 | SEQ ID NO: 1 | SEQ ID NO: 809 | — | — | SEQ ID NO: 156 | H-L1-C | SEQ ID NO: 683 |
|  | — | SEQ ID NO: 28 | SEQ ID NO: 261 | — | SEQ ID NO: 155 | H-L1-MM | SEQ ID NO: 267 |
| AK196 | SEQ ID NO: 1 | SEQ ID NO: 810 | — | — | SEQ ID NO: 156 | H-L1-C | SEQ ID NO: 684 |
|  | — | SEQ ID NO: 28 | SEQ ID NO: 261 | — | SEQ ID NO: 155 | H-L1-MM | SEQ ID NO: 267 |
| AK197 | SEQ ID NO: 3 | SEQ ID NO: 808 | — | — | SEQ ID NO: 156 | H-L1-C | SEQ ID NO: 685 |
|  | — | SEQ ID NO: 28 | SEQ ID NO: 261 | — | SEQ ID NO: 155 | H-L1-MM | SEQ ID NO: 267 |
| AK198 | SEQ ID NO: 3 | SEQ ID NO: 809 | — | — | SEQ ID NO: 156 | H-L1-C | SEQ ID NO: 686 |
|  | — | SEQ ID NO: 28 | SEQ ID NO: 261 | — | SEQ ID NO: 155 | H-L1-MM | SEQ ID NO: 267 |
| AK199 | SEQ ID NO: 3 | SEQ ID NO: 810 | — | — | SEQ ID NO: 156 | H-L1-C | SEQ ID NO: 687 |
|  | — | SEQ ID NO: 28 | SEQ ID NO: 261 | — | SEQ ID NO: 155 | H-L1-MM | SEQ ID NO: 267 |
| AK200 | SEQ ID NO: 1 | SEQ ID NO: 811 | — | — | SEQ ID NO: 156 | H-L1-C | SEQ ID NO: 688 |
|  | — | SEQ ID NO: 28 | SEQ ID NO: 261 | — | SEQ ID NO: 155 | H-L1-MM | SEQ ID NO: 267 |
| AK201 | SEQ ID NO: 1 | SEQ ID NO: 812 | — | — | SEQ ID NO: 156 | H-L1-C | SEQ ID NO: 689 |
|  | — | SEQ ID NO: 28 | SEQ ID NO: 261 | — | SEQ ID NO: 155 | H-L1-MM | SEQ ID NO: 267 |
| AK202 | SEQ ID NO: 1 | SEQ ID NO: 263 | — | — | SEQ ID NO: 156 | H-L1-C | SEQ ID NO: 690 |
|  | — | SEQ ID NO: 28 | SEQ ID NO: 261 | — | SEQ ID NO: 155 | H-L1-MM | SEQ ID NO: 267 |

TABLE 8-continued

| Construct # | Cytokine or functional fragment thereof (C) | Linker (L1) | Masking moiety (MM) | Linker (L2) | Half-life extension domain (H) | Structure (N- to C-terminal direction) | Amino Acid Sequence |
|---|---|---|---|---|---|---|---|
| AK203 | SEQ ID NO: 3 | SEQ ID NO: 811 | — | — | SEQ ID NO: 156 | H-L1-C | SEQ ID NO: 266 |
|  | — | SEQ ID NO: 28 | SEQ ID NO: 261 | — | SEQ ID NO: 155 | H-L1-MM | SEQ ID NO: 267 |
| AK204 | SEQ ID NO: 3 | SEQ ID NO: 812 | — | — | SEQ ID NO: 156 | H-L1-C | SEQ ID NO: 692 |
|  | — | SEQ ID NO: 28 | SEQ ID NO: 261 | — | SEQ ID NO: 155 | H-L1-MM | SEQ ID NO: 267 |
| AK205 | SEQ ID NO: 3 | SEQ ID NO: 263 | — | — | SEQ ID NO: 156 | H-L1-C | SEQ ID NO: 693 |
|  | — | SEQ ID NO: 28 | SEQ ID NO: 261 | — | SEQ ID NO: 155 | H-L1-MM | SEQ ID NO: 267 |
| AK206 | SEQ ID NO: 3 | SEQ ID NO: 800 | — | — | SEQ ID NO: 156 | H-L1-C | SEQ ID NO: 694 |
|  | — | SEQ ID NO: 28 | SEQ ID NO: 261 | — | SEQ ID NO: 155 | H-L1-MM | SEQ ID NO: 267 |
| AK207 | SEQ ID NO: 3 | SEQ ID NO: 801 | — | — | SEQ ID NO: 156 | H-L1-C | SEQ ID NO: 695 |
|  | — | SEQ ID NO: 28 | SEQ ID NO: 261 | — | SEQ ID NO: 155 | H-L1-MM | SEQ ID NO: 267 |
| AK208 | SEQ ID NO: 1 | SEQ ID NO: 804 | — | — | SEQ ID NO: 156 | H-L1-C | SEQ ID NO: 696 |
|  | — | SEQ ID NO: 28 | SEQ ID NO: 261 | — | SEQ ID NO: 155 | H-L1-MM | SEQ ID NO: 267 |
| AK209 | SEQ ID NO: 3 | SEQ ID NO: 802 | — | — | SEQ ID NO: 156 | H-L1-C | SEQ ID NO: 697 |
|  | — | SEQ ID NO: 28 | SEQ ID NO: 261 | — | SEQ ID NO: 155 | H-L1-MM | SEQ ID NO: 267 |
| AK210 | SEQ ID NO: 1 | SEQ ID NO: 807 | — | — | SEQ ID NO: 156 | H-L1-C | SEQ ID NO: 698 |
|  | — | SEQ ID NO: 28 | SEQ ID NO: 261 | — | SEQ ID NO: 155 | H-L1-MM | SEQ ID NO: 267 |
| AK211 | SEQ ID NO: 3 | SEQ ID NO: 339 | — | — | SEQ ID NO: 156 | H-L1-C | SEQ ID NO: 699 |
|  | — | SEQ ID NO: 28 | SEQ ID NO: 261 | — | SEQ ID NO: 155 | H-L1-MM | SEQ ID NO: 267 |
| AK212 | SEQ ID NO: 1 | SEQ ID NO: 339 | — | — | SEQ ID NO: 156 | H-L1-C | SEQ ID NO: 700 |
|  | — | SEQ ID NO: 28 | SEQ ID NO: 261 | — | SEQ ID NO: 155 | H-L1-MM | SEQ ID NO: 267 |
| AK215 | SEQ ID NO: 815 | SEQ ID NO: 11 | — | — | SEQ ID NO: 156 | H-L1-C | SEQ ID NO: 701 |
|  | — | SEQ ID NO: 28 | SEQ ID NO: 261 | — | SEQ ID NO: 155 | H-L1-MM | SEQ ID NO: 267 |
| AK216 | SEQ ID NO: 816 | SEQ ID NO: 11 | — | — | SEQ ID NO: 156 | H-L1-C | SEQ ID NO: 702 |
|  | — | SEQ ID NO: 28 | SEQ ID NO: 261 | — | SEQ ID NO: 155 | H-L1-MM | SEQ ID NO: 267 |
| AK217 | SEQ ID NO: 817 | SEQ ID NO: 11 | — | — | SEQ ID NO: 156 | H-L1-C | SEQ ID NO: 703 |
|  | — | SEQ ID NO: 28 | SEQ ID NO: 261 | — | SEQ ID NO: 155 | H-L1-MM | SEQ ID NO: 267 |
| AK218 | SEQ ID NO: 818 | SEQ ID NO: 11 | — | — | SEQ ID NO: 156 | H-L1-C | SEQ ID NO: 704 |
|  | — | SEQ ID NO: 28 | SEQ ID NO: 261 | — | SEQ ID NO: 155 | H-L1-MM | SEQ ID NO: 267 |
| AK219 | SEQ ID NO: 819 | SEQ ID NO: 11 | — | — | SEQ ID NO: 156 | H-L1-C | SEQ ID NO: 705 |
|  | — | SEQ ID NO: 28 | SEQ ID NO: 261 | — | SEQ ID NO: 155 | H-L1-MM | SEQ ID NO: 267 |
| AK220 | SEQ ID NO: 820 | SEQ ID NO: 11 | — | — | SEQ ID NO: 156 | H-L1-C | SEQ ID NO: 706 |
|  | — | SEQ ID NO: 28 | SEQ ID NO: 261 | — | SEQ ID NO: 155 | H-L1-MM | SEQ ID NO: 267 |
| AK221 | SEQ ID NO: 821 | SEQ ID NO: 11 | — | — | SEQ ID NO: 156 | H-L1-C | SEQ ID NO: 707 |
|  | — | SEQ ID NO: 28 | SEQ ID NO: 261 | — | SEQ ID NO: 155 | H-L1-MM | SEQ ID NO: 267 |
| AK222 | SEQ ID NO: 822 | SEQ ID NO: 11 | — | — | SEQ ID NO: 156 | H-L1-C | SEQ ID NO: 708 |
|  | — | SEQ ID NO: 28 | SEQ ID NO: 261 | — | SEQ ID NO: 155 | H-L1-MM | SEQ ID NO: 267 |
| AK223 | SEQ ID NO: 813 | SEQ ID NO: 11 | — | — | SEQ ID NO: 156 | H-L1-C | SEQ ID NO: 709 |
|  | — | SEQ ID NO: 28 | SEQ ID NO: 261 | — | SEQ ID NO: 155 | H-L1-MM | SEQ ID NO: 267 |
| AK224 | SEQ ID NO: 814 | SEQ ID NO: 11 | — | — | SEQ ID NO: 156 | H-L1-C | SEQ ID NO: 710 |
|  | — | SEQ ID NO: 28 | SEQ ID NO: 261 | — | SEQ ID NO: 155 | H-L1-MM | SEQ ID NO: 267 |
| AK225 | SEQ ID NO: 3 | SEQ ID NO: 803 | — | — | SEQ ID NO: 156 | H-L1-C | SEQ ID NO: 711 |
|  | — | SEQ ID NO: 28 | SEQ ID NO: 261 | — | SEQ ID NO: 155 | H-L1-MM | SEQ ID NO: 267 |
| AK228 | SEQ ID NO: 1 | SEQ ID NO: 339 | — | — | SEQ ID NO: 156 | H-L1-C | SEQ ID NO: 700 |
|  | — | — | — | — | SEQ ID NO: 265 | H | SEQ ID NO: 265 |
| AK231 | — | — | — | — | SEQ ID NO: 156 | H | SEQ ID NO: 156 |
|  | — | SEQ ID NO: 28 | SEQ ID NO: 261 | — | SEQ ID NO: 155 | H-L1-MM | SEQ ID NO: 267 |
| AK232 | SEQ ID NO: 3 | SEQ ID NO: 11 | — | — | SEQ ID NO: 156 | H-L1-C | SEQ ID NO: 667 |
|  | — | SEQ ID NO: 795 | SEQ ID NO: 261 | — | SEQ ID NO: 155 | H-L1-MM | SEQ ID NO: 712 |
| AK233 | SEQ ID NO: 1 | SEQ ID NO: 691 | — | — | SEQ ID NO: 156 | H-L1-C | SEQ ID NO: 713 |
|  | — | SEQ ID NO: 28 | SEQ ID NO: 261 | — | SEQ ID NO: 155 | H-L1-MM | SEQ ID NO: 267 |
| AK234 | SEQ ID NO: 3 | SEQ ID NO: 691 | — | — | SEQ ID NO: 156 | H-L1-C | SEQ ID NO: 714 |
|  | — | SEQ ID NO: 28 | SEQ ID NO: 261 | — | SEQ ID NO: 155 | H-L1-MM | SEQ ID NO: 267 |
| AK235 | SEQ ID NO: 3 | SEQ ID NO: 802 | — | — | SEQ ID NO: 156 | H-L1-C | SEQ ID NO: 697 |
|  | — | — | — | — | SEQ ID NO: 265 | H | SEQ ID NO: 265 |
| AK252 | — | SEQ ID NO: 15 | SEQ ID NO: 261 | — | SEQ ID NO: 155 | H-L1-MM | SEQ ID NO: 716 |
|  | SEQ ID NO: 3 | SEQ ID NO: 339 | — | — | SEQ ID NO: 156 | H-L1-C | SEQ ID NO: 699 |
| AK253 | SEQ ID NO: 3 | SEQ ID NO: 339 | — | — | SEQ ID NO: 156 | H-L1-C | SEQ ID NO: 699 |
|  | — | — | — | — | SEQ ID NO: 265 | H | SEQ ID NO: 265 |
| AK304 | SEQ ID NO: 815 | SEQ ID NO: 802 | — | — | SEQ ID NO: 156 | H-L1-C | SEQ ID NO: 717 |
|  | — | — | — | — | SEQ ID NO: 265 | H | SEQ ID NO: 265 |
| AK305 | SEQ ID NO: 815 | SEQ ID NO: 802 | — | — | SEQ ID NO: 156 | H-L1-C | SEQ ID NO: 717 |
|  | — | SEQ ID NO: 28 | SEQ ID NO: 261 | — | SEQ ID NO: 155 | H-L1-MM | SEQ ID NO: 267 |
| AK306 | SEQ ID NO: 816 | SEQ ID NO: 802 | — | — | SEQ ID NO: 156 | H-L1-C | SEQ ID NO: 718 |
|  | — | — | — | — | SEQ ID NO: 265 | H | SEQ ID NO: 265 |
| AK307 | SEQ ID NO: 816 | SEQ ID NO: 802 | — | — | SEQ ID NO: 156 | H-L1-C | SEQ ID NO: 718 |
|  | — | SEQ ID NO: 28 | SEQ ID NO: 261 | — | SEQ ID NO: 155 | H-L1-MM | SEQ ID NO: 267 |
| AK308 | SEQ ID NO: 818 | SEQ ID NO: 802 | — | — | SEQ ID NO: 156 | H-L1-C | SEQ ID NO: 719 |
|  | — | — | — | — | SEQ ID NO: 265 | H | SEQ ID NO: 265 |
| AK309 | SEQ ID NO: 818 | SEQ ID NO: 802 | — | — | SEQ ID NO: 156 | H-L1-C | SEQ ID NO: 719 |
|  | — | SEQ ID NO: 28 | SEQ ID NO: 261 | — | SEQ ID NO: 155 | H-L1-MM | SEQ ID NO: 267 |
| AK310 | SEQ ID NO: 819 | SEQ ID NO: 802 | — | — | SEQ ID NO: 156 | H-L1-C | SEQ ID NO: 720 |
|  | — | — | — | — | SEQ ID NO: 265 | H | SEQ ID NO: 265 |
| AK311 | SEQ ID NO: 819 | SEQ ID NO: 802 | — | — | SEQ ID NO: 156 | H-L1-C | SEQ ID NO: 720 |
|  | — | SEQ ID NO: 28 | SEQ ID NO: 261 | — | SEQ ID NO: 155 | H-L1-MM | SEQ ID NO: 267 |
| AK312 | SEQ ID NO: 820 | SEQ ID NO: 802 | — | — | SEQ ID NO: 156 | H-L1-C | SEQ ID NO: 722 |
|  | — | — | — | — | SEQ ID NO: 265 | H | SEQ ID NO: 265 |

TABLE 8-continued

| Construct # | Cytokine or functional fragment thereof (C) | Linker (L1) | Masking moiety (MM) | Linker (L2) | Half-life extension domain (H) | Structure (N- to C-terminal direction) | Amino Acid Sequence |
|---|---|---|---|---|---|---|---|
| AK313 | SEQ ID NO: 820 | SEQ ID NO: 802 | — | — | SEQ ID NO: 156 | H-L1-C | SEQ ID NO: 722 |
|  | — | SEQ ID NO: 28 | SEQ ID NO: 261 | — | SEQ ID NO: 155 | H-L1-MM | SEQ ID NO: 267 |
| AK314 | SEQ ID NO: 813 | SEQ ID NO: 802 | — | — | SEQ ID NO: 156 | H-L1-C | SEQ ID NO: 723 |
|  | — | — | — | — | SEQ ID NO: 265 | H | SEQ ID NO: 265 |
| AK315 | SEQ ID NO: 813 | SEQ ID NO: 802 | — | — | SEQ ID NO: 156 | H-L1-C | SEQ ID NO: 723 |
|  | — | SEQ ID NO: 28 | SEQ ID NO: 261 | — | SEQ ID NO: 155 | H-L1-MM | SEQ ID NO: 267 |
| AK316 | SEQ ID NO: 1 | SEQ ID NO: 802 | — | — | SEQ ID NO: 156 | H-L1-C | SEQ ID NO: 674 |
|  | — | SEQ ID NO: 28 | SEQ ID NO: 261 | — | SEQ ID NO: 155 | H-L1-MM | SEQ ID NO: 267 |
| AK325 | SEQ ID NO: 815 | SEQ ID NO: 11 | — | — | SEQ ID NO: 156 | H-L1-C | SEQ ID NO: 701 |
|  | — | SEQ ID NO: 28 | SEQ ID NO: 261 | — | SEQ ID NO: 155 | H-L1-MM | SEQ ID NO: 267 |
| AK326 | SEQ ID NO: 816 | SEQ ID NO: 11 | — | — | SEQ ID NO: 156 | H-L1-C | SEQ ID NO: 702 |
|  | — | SEQ ID NO: 28 | SEQ ID NO: 261 | — | SEQ ID NO: 155 | H-L1-MM | SEQ ID NO: 267 |
| AK327 | SEQ ID NO: 818 | SEQ ID NO: 11 | — | — | SEQ ID NO: 156 | H-L1-C | SEQ ID NO: 704 |
|  | — | SEQ ID NO: 28 | SEQ ID NO: 261 | — | SEQ ID NO: 155 | H-L1-MM | SEQ ID NO: 267 |
| AK328 | SEQ ID NO: 819 | SEQ ID NO: 11 | — | — | SEQ ID NO: 156 | H-L1-C | SEQ ID NO: 705 |
|  | — | SEQ ID NO: 28 | SEQ ID NO: 261 | — | SEQ ID NO: 155 | H-L1-MM | SEQ ID NO: 267 |
| AK329 | SEQ ID NO: 820 | SEQ ID NO: 11 | — | — | SEQ ID NO: 156 | H-L1-C | SEQ ID NO: 706 |
|  | — | SEQ ID NO: 28 | SEQ ID NO: 261 | — | SEQ ID NO: 155 | H-L1-MM | SEQ ID NO: 267 |
| AK330 | SEQ ID NO: 813 | SEQ ID NO: 11 | — | — | SEQ ID NO: 156 | H-L1-C | SEQ ID NO: 709 |
|  | — | SEQ ID NO: 28 | SEQ ID NO: 261 | — | SEQ ID NO: 155 | H-L1-MM | SEQ ID NO: 267 |
| AK349 | SEQ ID NO: 813 | SEQ ID NO: 807 | — | — | SEQ ID NO: 156 | H-L1-C | SEQ ID NO: 728 |
|  | — | SEQ ID NO: 28 | SEQ ID NO: 261 | — | SEQ ID NO: 155 | H-L1-MM | SEQ ID NO: 267 |
| AK350 | SEQ ID NO: 813 | SEQ ID NO: 797 | — | — | SEQ ID NO: 156 | H-L1-C | SEQ ID NO: 729 |
|  | — | SEQ ID NO: 28 | SEQ ID NO: 261 | — | SEQ ID NO: 155 | H-L1-MM | SEQ ID NO: 267 |
| AK351 | SEQ ID NO: 813 | SEQ ID NO: 798 | — | — | SEQ ID NO: 156 | H-L1-C | SEQ ID NO: 730 |
|  | — | SEQ ID NO: 28 | SEQ ID NO: 261 | — | SEQ ID NO: 155 | H-L1-MM | SEQ ID NO: 267 |
| AK352 | SEQ ID NO: 813 | SEQ ID NO: 724 | — | — | SEQ ID NO: 156 | H-L1-C | SEQ ID NO: 731 |
|  | — | SEQ ID NO: 28 | SEQ ID NO: 261 | — | SEQ ID NO: 155 | H-L1-MM | SEQ ID NO: 267 |
| AK353 | SEQ ID NO: 813 | SEQ ID NO: 725 | — | — | SEQ ID NO: 156 | H-L1-C | SEQ ID NO: 732 |
|  | — | SEQ ID NO: 28 | SEQ ID NO: 261 | — | SEQ ID NO: 155 | H-L1-MM | SEQ ID NO: 267 |
| AK354 | SEQ ID NO: 813 | SEQ ID NO: 536 | — | — | SEQ ID NO: 156 | H-L1-C | SEQ ID NO: 733 |
|  | — | SEQ ID NO: 28 | SEQ ID NO: 261 | — | SEQ ID NO: 155 | H-L1-MM | SEQ ID NO: 267 |
| AK355 | SEQ ID NO: 813 | SEQ ID NO: 537 | — | — | SEQ ID NO: 156 | H-L1-C | SEQ ID NO: 734 |
|  | — | SEQ ID NO: 28 | SEQ ID NO: 261 | — | SEQ ID NO: 155 | H-L1-MM | SEQ ID NO: 267 |
| AK357 | SEQ ID NO: 813 | SEQ ID NO: 502 | — | — | SEQ ID NO: 156 | H-L1-C | SEQ ID NO: 735 |
|  | — | SEQ ID NO: 28 | SEQ ID NO: 261 | — | SEQ ID NO: 155 | H-L1-MM | SEQ ID NO: 267 |
| AK358 | SEQ ID NO: 813 | SEQ ID NO: 503 | — | — | SEQ ID NO: 156 | H-L1-C | SEQ ID NO: 736 |
|  | — | SEQ ID NO: 28 | SEQ ID NO: 261 | — | SEQ ID NO: 155 | H-L1-MM | SEQ ID NO: 267 |
| AK359 | SEQ ID NO: 813 | SEQ ID NO: 492 | — | — | SEQ ID NO: 156 | H-L1-C | SEQ ID NO: 737 |
|  | — | SEQ ID NO: 28 | SEQ ID NO: 261 | — | SEQ ID NO: 155 | H-L1-MM | SEQ ID NO: 267 |
| AK360 | SEQ ID NO: 813 | SEQ ID NO: 493 | — | — | SEQ ID NO: 156 | H-L1-C | SEQ ID NO: 738 |
|  | — | SEQ ID NO: 28 | SEQ ID NO: 261 | — | SEQ ID NO: 155 | H-L1-MM | SEQ ID NO: 267 |
| AK361 | SEQ ID NO: 813 | SEQ ID NO: 416 | — | — | SEQ ID NO: 156 | H-L1-C | SEQ ID NO: 739 |
|  | — | SEQ ID NO: 28 | SEQ ID NO: 261 | — | SEQ ID NO: 155 | H-L1-MM | SEQ ID NO: 267 |
| AK362 | SEQ ID NO: 813 | SEQ ID NO: 417 | — | — | SEQ ID NO: 156 | H-L1-C | SEQ ID NO: 740 |
|  | — | SEQ ID NO: 28 | SEQ ID NO: 261 | — | SEQ ID NO: 155 | H-L1-MM | SEQ ID NO: 267 |
| AK363 | SEQ ID NO: 813 | SEQ ID NO: 418 | — | — | SEQ ID NO: 156 | H-L1-C | SEQ ID NO: 741 |
|  | — | SEQ ID NO: 28 | SEQ ID NO: 261 | — | SEQ ID NO: 155 | H-L1-MM | SEQ ID NO: 267 |
| AK364 | SEQ ID NO: 813 | SEQ ID NO: 419 | — | — | SEQ ID NO: 156 | H-L1-C | SEQ ID NO: 742 |
|  | — | SEQ ID NO: 28 | SEQ ID NO: 261 | — | SEQ ID NO: 155 | H-L1-MM | SEQ ID NO: 267 |
| AK365 | SEQ ID NO: 813 | SEQ ID NO: 350 | — | — | SEQ ID NO: 156 | H-L1-C | SEQ ID NO: 743 |
|  | — | SEQ ID NO: 28 | SEQ ID NO: 261 | — | SEQ ID NO: 155 | H-L1-MM | SEQ ID NO: 267 |
| AK366 | SEQ ID NO: 813 | SEQ ID NO: 351 | — | — | SEQ ID NO: 156 | H-L1-C | SEQ ID NO: 744 |
|  | — | SEQ ID NO: 28 | SEQ ID NO: 261 | — | SEQ ID NO: 155 | H-L1-MM | SEQ ID NO: 267 |
| AK367 | SEQ ID NO: 813 | SEQ ID NO: 352 | — | — | SEQ ID NO: 156 | H-L1-C | SEQ ID NO: 745 |
|  | — | SEQ ID NO: 28 | SEQ ID NO: 261 | — | SEQ ID NO: 155 | H-L1-MM | SEQ ID NO: 267 |
| AK368 | SEQ ID NO: 813 | SEQ ID NO: 353 | — | — | SEQ ID NO: 156 | H-L1-C | SEQ ID NO: 746 |
|  | — | SEQ ID NO: 28 | SEQ ID NO: 261 | — | SEQ ID NO: 155 | H-L1-MM | SEQ ID NO: 267 |
| AK317 | SEQ ID NO: 1 | SEQ ID NO: 802 | — | — | SEQ ID NO: 156 | H-L1-C | SEQ ID NO: 674 |
|  | — | SEQ ID NO: 28 | SEQ ID NO: 826 | — | SEQ ID NO: 155 | H-L1-MM | SEQ ID NO: 828 |
| AK324 | SEQ ID NO: 1 | SEQ ID NO: 802 | — | — | SEQ ID NO: 156 | H-L1-C | SEQ ID NO: 674 |
|  | — | SEQ ID NO: 28 | SEQ ID NO: 827 | — | SEQ ID NO: 155 | H-L1-MM | SEQ ID NO: 829 |
| AK341 | SEQ ID NO: 3 | SEQ ID NO: 802 | — | — | SEQ ID NO: 156 | H-L1-C | SEQ ID NO: 726 |
|  | — | SEQ ID NO: 28 | SEQ ID NO: 826 | — | SEQ ID NO: 155 | H-L1-MM | SEQ ID NO: 830 |
| AK342 | SEQ ID NO: 3 | SEQ ID NO: 802 | — | — | SEQ ID NO: 156 | H-L1-C | SEQ ID NO: 726 |
|  | — | SEQ ID NO: 28 | SEQ ID NO: 827 | — | SEQ ID NO: 155 | H-L1-MM | SEQ ID NO: 829 |

Also generated are masked IL-15 polypeptide constructs that include an IL-15 polypeptide or functional fragment thereof, a masking moiety, a first half-life extension domain, and a second half-life extension domain, such as albumin, an antibody or fragment thereof (e.g., an Fc region, heavy chain, and/or light chain), an albumin-binding peptide, an IgG-binding peptide, or a polyamino acid sequence. The masking moiety is linked to the first half-life extension domain, the IL-15 polypeptide or functional fragment thereof is linked to the second half-life extension domain, and the first half-life extension domain and the second half-life extension domain contain modifications promoting the association of the first and the second half-life extension domain. Some of the constructs also include a linker that links the masking moiety to the first half-life extension domain, and/or a linker that links the IL-15 polypeptide or functional fragment thereof to the second half-life extension domain. The first and second half-life extension domain of some of the constructs are also linked. In some constructs, the first and second half-life extension domain of some of the constructs are linked by a linker. Some of the constructs include a cleavable peptide in the linker linking the masking moiety to the first half-life extension domain and/or the linker linking the IL-15 polypeptide or functional fragment thereof to the second half-life extension domain, thereby resulting in an activatable masked IL-15 polypeptide construct. The masked IL-15 polypeptide constructs that do not include a cleavable peptide in either the linker that links the IL-15 polypeptide or functional fragment thereof to the second half-life extension domain or the linker that links the masking moiety to the first half-life extension domain are also referred to as non-activatable masked IL-15 polypeptide constructs or non-activatable IL-15 polypeptide constructs because they do not include a cleavable peptide. The structure and composition of exemplary IL-15 polypeptide constructs are provided in Table 9.

first half-life extension domain, and a second half-life extension domain, such as albumin, an antibody or fragment thereof (e.g., an Fc region, heavy chain, and/or light chain), an albumin-binding peptide, an IgG-binding peptide, or a polyamino acid sequence. The first masking moiety is linked to the first half-life extension domain, the second masking moiety is linked to the IL-2 polypeptide or functional fragment thereof, either the second masking moiety or the IL-2 polypeptide or functional fragment thereof is linked to the second half-life extension domain, and the first half-life extension domain and the second half-life extension domain contain modifications promoting the association of the first and second half-life extension domain. Some of the constructs also include a linker that links the first masking moiety to the first half-life extension domain, and/or a linker that linkers the second masking moiety to the IL-2 polypeptide or functional fragment thereof. The first and second half-life extension domain of some of the constructs are also linked. In some constructs, the first and second half-life extension domain of some of the constructs are linked by a linker. Some of the constructs include a cleavable peptide in the linker linking the first masking moiety to the first

TABLE 9

| Construct # | Cytokine or functional fragment thereof (C) | Linker (L1) | Masking moiety (MM) | Linker (L2) | Half-life extension domain (H) | Structure (N- to C-terminal direction) | Amino Acid Sequence |
|---|---|---|---|---|---|---|---|
| 3033 | — | SEQ ID NO: 28 | SEQ ID NO: 10 | — | SEQ ID NO: 155 | H-L1-MM | |
| | SEQ ID NO: 167 | SEQ ID NO: 11 | — | — | SEQ ID NO: 156 | H-L1-C | |
| 3034 | — | SEQ ID NO: 28 | SEQ ID NO: 10 | — | SEQ ID NO: 155 | MM-L1-H | |
| | SEQ ID NO: 167 | SEQ ID NO: 11 | — | — | SEQ ID NO: 156 | C-L1-H | |
| 3035 | — | SEQ ID NO: 28 | SEQ ID NO: 10 | — | SEQ ID NO: 155 | MM-L1-H | |
| | SEQ ID NO: 167 | SEQ ID NO: 11 | — | — | SEQ ID NO: 156 | C-L1-H | |
| 3036 | — | SEQ ID NO: 28 | SEQ ID NO: 232 | — | SEQ ID NO: 155 | H-L1-MM | |
| | SEQ ID NO: 167 | SEQ ID NO: 11 | — | — | SEQ ID NO: 156 | H-L1-C | |
| 3037 | — | SEQ ID NO: 28 | SEQ ID NO: 233 | — | SEQ ID NO: 155 | MM-L1-H | |
| | SEQ ID NO: 167 | SEQ ID NO: 11 | — | — | SEQ ID NO: 156 | C-L1-H | |
| 3038 | — | SEQ ID NO: 28 | SEQ ID NO: 233 | — | SEQ ID NO: 155 | H-L1-MM | |
| | SEQ ID NO: 167 | SEQ ID NO: 11 | — | — | SEQ ID NO: 156 | H-L1-C | |
| AK243 | SEQ ID NO: 167 | SEQ ID NO: 668 | — | — | SEQ ID NO: 156 | H-L1-C | SEQ ID NO: 715 |
| | — | — | — | — | SEQ ID NO: 265 | H | SEQ ID NO: 265 |
| AK247 | SEQ ID NO: 167 | SEQ ID NO: 845 | — | — | SEQ ID NO: 156 | H-L1-C | SEQ ID NO: 747 |
| | — | SEQ ID NO: 799 | SEQ ID NO: 261 | — | SEQ ID NO: 156 | H-L1-MM | SEQ ID NO: 671 |
| AK248 | SEQ ID NO: 167 | SEQ ID NO: 668 | — | — | SEQ ID NO: 156 | H-L1-C | SEQ ID NO: 715 |
| | — | SEQ ID NO: 28 | SEQ ID NO: 261 | — | SEQ ID NO: 155 | H-L1-MM | SEQ ID NO: 267 |
| AK248b | SEQ ID NO: 167 | SEQ ID NO: 668 | — | — | SEQ ID NO: 156 | H-L1-C | SEQ ID NO: 715 |
| | — | SEQ ID NO: 799 | SEQ ID NO: 261 | — | SEQ ID NO: 156 | H-L1-MM | SEQ ID NO: 671 |
| AK249 | SEQ ID NO: 167 | SEQ ID NO: 355 | — | — | SEQ ID NO: 156 | H-L1-C | SEQ ID NO: 748 |
| | — | SEQ ID NO: 799 | SEQ ID NO: 261 | — | SEQ ID NO: 156 | H-L1-MM | SEQ ID NO: 671 |
| AK250 | SEQ ID NO: 167 | SEQ ID NO: 354 | SEQ ID NO: 823 | SEQ ID NO: 27 | SEQ ID NO: 156 | H-L1-C-L2-MM | SEQ ID NO: 749 |
| | — | SEQ ID NO: 799 | SEQ ID NO: 261 | — | SEQ ID NO: 156 | H-L1-MM | SEQ ID NO: 671 |
| AK251 | SEQ ID NO: 167 | SEQ ID NO: 354 | SEQ ID NO: 824 | SEQ ID NO: 27 | SEQ ID NO: 156 | H-L1-C-L2-MM | SEQ ID NO: 750 |
| | — | SEQ ID NO: 799 | SEQ ID NO: 261 | — | SEQ ID NO: 156 | H-L1-MM | SEQ ID NO: 671 |
| AK418 | SEQ ID NO: 167 | SEQ ID NO: 348 | — | — | SEQ ID NO: 156 | H-L1-C | SEQ ID NO: 751 |
| | — | SEQ ID NO: 799 | SEQ ID NO: 261 | — | SEQ ID NO: 156 | H-L1-MM | SEQ ID NO: 671 |
| AK419 | SEQ ID NO: 167 | SEQ ID NO: 668 | SEQ ID NO: 823 | SEQ ID NO: 27 | SEQ ID NO: 156 | H-L1-C-L2-MM | SEQ ID NO: 752 |
| | — | SEQ ID NO: 799 | SEQ ID NO: 261 | — | SEQ ID NO: 156 | H-L1-MM | SEQ ID NO: 671 |
| AK420 | SEQ ID NO: 167 | SEQ ID NO: 668 | SEQ ID NO: 824 | SEQ ID NO: 27 | SEQ ID NO: 156 | H-L1-C-L2-MM | SEQ ID NO: 753 |
| | — | SEQ ID NO: 799 | SEQ ID NO: 261 | — | SEQ ID NO: 156 | H-L1-MM | SEQ ID NO: 671 |
| AK421 | SEQ ID NO: 167 | SEQ ID NO: 349 | — | — | SEQ ID NO: 156 | H-L1-C | SEQ ID NO: 754 |
| | — | SEQ ID NO: 799 | SEQ ID NO: 261 | — | SEQ ID NO: 156 | H-L1-MM | SEQ ID NO: 671 |
| AK399 | SEQ ID NO: 167 | SEQ ID NO: 320 | SEQ ID NO: 823 | SEQ ID NO: 321 | SEQ ID NO: 156 | H-L1-C-L2-MM | SEQ ID NO: 758 |
| | — | SEQ ID NO: 799 | SEQ ID NO: 261 | — | SEQ ID NO: 156 | H-L1-MM | SEQ ID NO: 671 |
| AK405 | SEQ ID NO: 167 | SEQ ID NO: 320 | SEQ ID NO: 823 | SEQ ID NO: 322 | SEQ ID NO: 156 | H-L1-C-L2-MM | SEQ ID NO: 759 |
| | — | SEQ ID NO: 799 | SEQ ID NO: 261 | — | SEQ ID NO: 156 | H-L1-MM | SEQ ID NO: 671 |
| AK400 | SEQ ID NO: 167 | SEQ ID NO: 349 | SEQ ID NO: 824 | SEQ ID NO: 30 | SEQ ID NO: 156 | H-L1-C-L2-MM | SEQ ID NO: 760 |
| | — | SEQ ID NO: 799 | SEQ ID NO: 261 | — | SEQ ID NO: 156 | H-L1-MM | SEQ ID NO: 671 |
| AK404 | SEQ ID NO: 167 | SEQ ID NO: 349 | SEQ ID NO: 823 | SEQ ID NO: 30 | SEQ ID NO: 156 | H-L1-C-L2-MM | SEQ ID NO: 761 |
| | — | SEQ ID NO: 799 | SEQ ID NO: 261 | — | SEQ ID NO: 156 | H-L1-MM | SEQ ID NO: 671 |

Also generated are masked IL-2 polypeptide constructs that include an IL-2 polypeptide or functional fragment thereof, a first masking moiety, a second masking moiety, a half-life extension domain, and/or include a cleavable peptide in the linker linking the second masking moiety to the IL-2 polypeptide or functional fragment thereof, thereby resulting in an activatable masked IL-2 polypeptide construct. The masked IL-2 polypeptide constructs that do not include a cleavable peptide in either the linker that links the first masking moiety to the first half-life extension domain or the linker linking the second masking moiety to the IL-2 polypeptide or functional fragment thereof are also referred to as non-activatable masked IL-2 polypeptide constructs or non-activatable IL-2 polypeptide constructs because they do not include a cleavable peptide. The structure and composition of exemplary IL-2 polypeptide constructs are provided in Table 10.

and second half-life extension domain. Some of the constructs also include a linker that links the first masking moiety to the first half-life extension domain, and/or a linker that linkers the second masking moiety to the IL-15 polypeptide or functional fragment thereof. The first and second half-life extension domain of some of the constructs are also linked. In some constructs, the first and second half-life extension domain of some of the constructs are linked by a linker. Some of the constructs include a cleavable peptide in the linker linking the first masking moiety to the first half-life extension domain, and/or include a cleavable pep-

TABLE 10

| Construct # | Cytokine or functional fragment thereof (C) | Linker (L1) | Masking moiety (MM) | Linker (L2) | Half-life extension domain (H) | Structure (N- to C-terminal direction) |
|---|---|---|---|---|---|---|
| 4000 | — | SEQ ID NO: 28 | SEQ ID NO: 10 | — | SEQ ID NO: 155 | H-L1-MM |
|  | SEQ ID NO: 1 | SEQ ID NO: 11 | SEQ ID NO: 9 | SEQ ID NO: 15 | SEQ ID NO: 156 | H-L1-C-L2-MM |
| 4001 | — | SEQ ID NO: 28 | SEQ ID NO: 10 | — | SEQ ID NO: 155 | H-L1-MM |
|  | SEQ ID NO: 3 | SEQ ID NO: 11 | SEQ ID NO: 9 | SEQ ID NO: 16 | SEQ ID NO: 156 | H-L1-C-L2-MM |
| 4002 | — | SEQ ID NO: 28 | SEQ ID NO: 10 | — | SEQ ID NO: 155 | H-L1-MM |
|  | SEQ ID NO: 4 | SEQ ID NO: 11 | SEQ ID NO: 9 | SEQ ID NO: 17 | SEQ ID NO: 156 | H-L1-C-L2-MM |
| 4003 | — | SEQ ID NO: 28 | SEQ ID NO: 10 | — | SEQ ID NO: 155 | MM-L1-H |
|  | SEQ ID NO: 5 | SEQ ID NO: 11 | SEQ ID NO: 9 | SEQ ID NO: 18 | SEQ ID NO: 156 | MM-L2-C-L1-H |
| 4004 | — | SEQ ID NO: 28 | SEQ ID NO: 10 | — | SEQ ID NO: 155 | MM-L1-H |
|  | SEQ ID NO: 6 | SEQ ID NO: 11 | SEQ ID NO: 9 | SEQ ID NO: 19 | SEQ ID NO: 156 | MM-L2-C-L1-H |
| 4005 | — | SEQ ID NO: 28 | SEQ ID NO: 10 | — | SEQ ID NO: 155 | MM-L1-H |
|  | SEQ ID NO: 7 | SEQ ID NO: 11 | SEQ ID NO: 9 | SEQ ID NO: 15 | SEQ ID NO: 156 | MM-L2-C-L1-H |
| 4006 | — | SEQ ID NO: 28 | SEQ ID NO: 10 | — | SEQ ID NO: 155 | H-L1-MM |
|  | SEQ ID NO: 8 | SEQ ID NO: 11 | SEQ ID NO: 9 | SEQ ID NO: 16 | SEQ ID NO: 156 | H-L1-C-L2-MM |

Also generated are masked IL-15 polypeptide constructs that include an IL-15 polypeptide or functional fragment thereof, a first masking moiety, a second masking moiety, a first half-life extension domain, and a second half-life extension domain, such as albumin, an antibody or fragment thereof (e.g., an Fc region, heavy chain, and/or light chain), an albumin-binding peptide, an IgG-binding peptide, or a polyamino acid sequence. The first masking moiety is linked to the first half-life extension domain, the second masking moiety is linked to the IL-15 polypeptide or functional fragment thereof, either the second masking moiety or the IL-15 polypeptide or functional fragment thereof is linked to the second half-life extension domain, and the first half-life extension domain and the second half-life extension domain contain modifications promoting the association of the first tide in the linker linking the second masking moiety to the IL-15 polypeptide or functional fragment thereof, thereby resulting in an activatable masked IL-15 polypeptide construct. The masked IL-15 polypeptide constructs that do not include a cleavable peptide in either the linker that links the first masking moiety to the first half-life extension domain or the linker linking the second masking moiety to the IL-15 polypeptide or functional fragment thereof are also referred to as non-activatable masked IL-15 polypeptide constructs or non-activatable IL-15 polypeptide constructs because they do not include a cleavable peptide. The structure and composition of exemplary IL-2 polypeptide constructs are provided in Table 11.

TABLE 11

| Construct # | Cytokine or functional fragment thereof (C) | Linker (L1) | Masking moiety (MM) | Linker (L2) | Half-life extension domain (H) | Structure (N- to C-terminal direction) |
|---|---|---|---|---|---|---|
| 3034 | — | SEQ ID NO: 28 | SEQ ID NO: 10 | — | SEQ ID NO: 155 | H-L1-MM |
|  | SEQ ID NO: 167 | SEQ ID NO: 11 | SEQ ID NO: 232 | SEQ ID NO: 235 | SEQ ID NO: 156 | H-L1-C-L2-MM |
| 3035 | — | SEQ ID NO: 28 | SEQ ID NO: 10 | — | SEQ ID NO: 155 | H-L1-MM |
|  | SEQ ID NO: 167 | SEQ ID NO: 11 | SEQ ID NO: 233 | SEQ ID NO: 235 | SEQ ID NO: 156 | H-L1-C-L2-MM |
| 3036 | — | SEQ ID NO: 28 | SEQ ID NO: 10 | — | SEQ ID NO: 155 | H-L1-MM |
|  | SEQ ID NO: 167 | SEQ ID NO: 11 | SEQ ID NO: 234 | SEQ ID NO: 235 | SEQ ID NO: 156 | H-L1-C-L2-MM |
| 3038 | — | SEQ ID NO: 28 | SEQ ID NO: 10 | — | SEQ ID NO: 155 | MM-L1-H |
|  | SEQ ID NO: 167 | SEQ ID NO: 11 | SEQ ID NO: 232 | SEQ ID NO: 235 | SEQ ID NO: 156 | MM-L2-C-L1-H |
| 3039 | — | SEQ ID NO: 28 | SEQ ID NO: 10 | — | SEQ ID NO: 155 | MM-L1-H |
|  | SEQ ID NO: 167 | SEQ ID NO: 11 | SEQ ID NO: 233 | SEQ ID NO: 235 | SEQ ID NO: 156 | MM-L2-C-L1-H |

TABLE 11-continued

| Construct # | Cytokine or functional fragment thereof (C) | Linker (L1) | Masking moiety (MM) | Linker (L2) | Half-life extension domain (H) | Structure (N- to C-terminal direction) |
|---|---|---|---|---|---|---|
| 3040 | — SEQ ID NO: 167 | SEQ ID NO: 28 SEQ ID NO: 11 | SEQ ID NO: 10 SEQ ID NO: 234 | — SEQ ID NO: 235 | SEQ ID NO: 155 SEQ ID NO: 156 | MM-L1-H MM-L2-C-L1-H |

Example 2: In Vitro Characterization of Masked IL-2 and IL-15 Polypeptides

The masked IL-2 polypeptide constructs and masked IL-15 polypeptide constructs generated in Example 1 are characterized using several cellular and functional assays in vitro.

Production

Plasmids encoding the constructs (e.g., masked IL-2 polypeptide constructs and masked IL-15 polypeptide constructs) were transfected into either Expi293 cells (Life Technologies A14527) or HEK293-6E cells (National Research Council; NRC). Transfections were performed using 1 mg of total DNA using PEIpro (Polyplus Transfection, 115-100) in a 1:1 ratio with the total DNA. The DNA and PEI were each added to 50 mL of OptiMem (Life Technologies 31985088) medium and sterile filtered. The DNA and PEI were combined for 10 minutes and added to the Expi293 cells with a cell density of 1.8–2.8×10⁶ cells/mL or 0.85–1.20×10⁶ cells/m, for expi293 cells or HEK293 cells, respectively, and a viability of at least 95%. The HEK293-6E transfection was performed with a cell density of and a viability of at least 95%, following the same protocol used for the Expi293 transfections. After 5-7 days, the cells were pelleted by centrifugation at 3000×g and the supernatant was filtered through a 0.2 µm membrane. Protein A resin (CaptivA, Repligen CA-PRI-0005) was added to the filtered supernatant and incubated for at least 2 hours at 4° C. with shaking. The resin was packed into a column, washed with 15 column volumes of 20 mM citrate, pH 6.5, and then washed with 15 column volumes of 20 mM citrate, 500 mM sodium chloride, pH 6.5. The bound protein was eluted from the column with 20 mM citrate, 100 mM NaCl, pH 2.9.

The titer (mg/L) of exemplary constructs produced, including parental (e.g., non-masked) and masked constructs, is provided in Table 12, below.

TABLE 12

| Construct ID | Titer (mg/L) | Construct ID | Titer (mg/L) | Construct ID | Titer (mg/L) | Construct ID | Titer (mg/L) |
|---|---|---|---|---|---|---|---|
| AK032 | 5.8 | AK063 | 3.5 | AK165 | 13.5 | AK314 | 60 |
| AK033 | 9.6 | AK064 | 1.5 | AK166 | 17.1 | AK315 | 59.8 |
| AK034 | 13.9 | AK065 | 3.2 | AK167 | 56.4 | AK316 | 69.2 |
| AK035 | 16.7 | AK066 | 3.5 | AK168 | 36.1 | AK325 | 3.2 |
| AK036 | 25 | AK076 | 1.4 | AK184 | 21.6 | AK326 | 33.1 |
| AK037 | 11.1 | AK077 | 1.5 | AK188 | 12.8 | AK327 | 68.5 |
| AK039 | 3.5 | AK078 | 4.4 | AK203 | 83.2 | AK328 | 28.8 |
| AK040 | 0.7 | AK079 | 4.3 | AK209 | 27.3 | AK329 | 181 |
| AK042 | 1.9 | AK080 | 2.3 | AK211 | 43.8 | AK330 | 51 |
| AK043 | 1.1 | AK081 | 23.5 | AK212 | 18.2 | AK341 | 58 |
| AK044 | 15 | AK083 | 3.3 | AK225 | 44.1 | AK342 | 24 |
| AK045 | 9.3 | AK084 | 3.2 | AK226 | 20.2 | AK349 | 39.6 |
| AK046 | 12.5 | AK085 | 2.1 | AK227 | 27.4 | AK350 | 7.8 |
| AK047 | 18.5 | AK086 | 3.2 | AK228 | 20.1 | AK351 | 9.3 |
| AK048 | 24 | AK087 | 3.2 | AK231 | 19.3 | AK352 | 9.9 |
| AK049 | 12.2 | AK088 | 41 | AK233 | 36.4 | AK353 | 11 |
| AK050 | 12.8 | AK090 | 14.8 | AK234 | 33.3 | AK354 | 9.8 |
| AK051 | 11.9 | AK092 | 6.3 | AK235 | 35.9 | AK355 | 13.7 |
| AK052 | 10 | AK094 | 17.1 | AK252 | 68 | AK357 | 13.1 |
| AK053 | 15.2 | AK106 | 10.5 | AK253 | 41.4 | AK358 | 12.4 |
| AK054 | 11.9 | AK107 | 0 | AK304 | 19.9 | AK359 | 10.4 |
| AK055 | 13.2 | AK109 | 12.6 | AK305 | 53.2 | AK360 | 11.1 |
| AK056 | 9.2 | AK110 | 23.8 | AK306 | 29.3 | AK361 | 13.7 |
| AK057 | 10.8 | AK111 | 12.7 | AK307 | 62.9 | AK362 | 9.3 |
| AK058 | 13.5 | AK112 | 21.6 | AK308 | 74.5 | AK363 | 13.2 |
| AK059 | 3.7 | AK113 | 25.3 | AK309 | 90.8 | AK364 | 7.9 |
| AK060 | 1.2 | AK114 | 29 | AK310 | 44 | AK365 | 10.9 |
| AK061 | 3.5 | AK115 | 15 | AK311 | 64.9 | AK366 | 8.3 |
| AK062 | 0.6 | AK163 | 7.5 | AK312 | 154 | AK367 | 10.3 |
| AK248 | 47.7 | AK164 | 4 | AK313 | 81.2 | AK368 | 7.1 |

For SDS-PAGE analysis, protein samples were made with 4× Laemmli sample buffer (BioRad Catalog Number 1610747). For the reduced samples, 0.1 M Bond Breaker TCEP Solution (Thermo Scientific 77720) was added and the samples were heated for 5 minutes at 65° C. The proteins were loaded into a 12-well NuPage 4-12% Bis-Tris Protein Gel (Invitrogen NP0322BOX), with 4 µg of protein loaded per well. The gel was stained using SimplyBlue SafeStain (Invitrogen LC6065).

Figure 8:
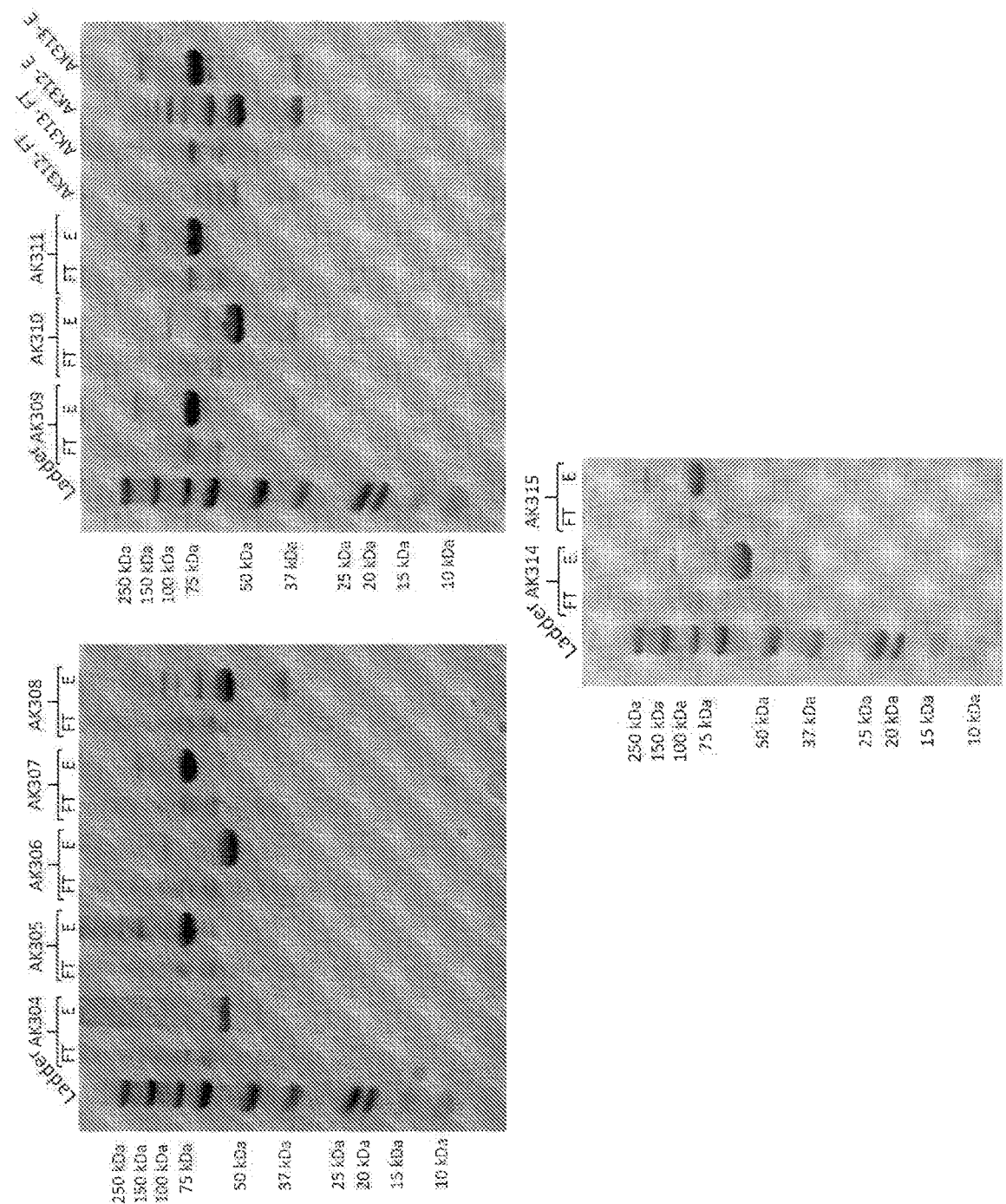
FIG. 8 shows SDS-PAGE analysis on flow-through (FT) samples (i.e., proteins that did not bind to the Protein A column) and the eluted (E) samples (i.e., proteins that bound to the Protein A column and were eluted from it) following production and purification of exemplary constructs (AK304, AK305, AK307, AK308, AK309, AK310, AK311, AK312, AK313, AK314, and AK315).

As depicted in FIG. 8, SDS-PAGE analysis was performed on the flow-through (FT) samples (i.e., proteins that did not bind to the Protein A column) and the eluted (E) samples (i.e., proteins that bound to the Protein A column and were eluted from it) following production and purification of exemplary constructs (AK304, AK305, AK307, AK308, AK309, AK310, AK311, AK312, AK313, AK314, and AK315). This exemplary data demonstrates that constructs as described herein can be successfully produced and purified.

Reporter Bioassays

Reporter bioassays are performed on masked IL-2 polypeptide constructs and masked IL-15 polypeptide constructs, along with non-masked parental constructs or other controls, to monitor activation of a downstream pathway, such as the JAK-STAT pathway.

Figure 22A:
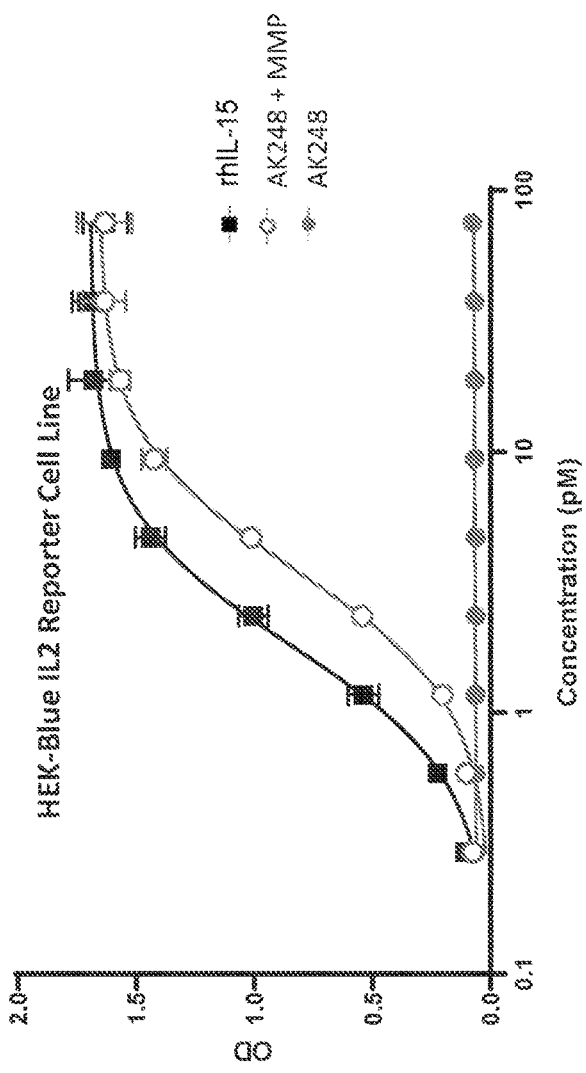
FIGS. 22A and 22B show the results from reporter bioassays on an exemplary masked IL-15 polypeptide construct, AK248, with (+MMP) or without prior exposure to an activating protease, or a rhIL-15 as a control.
Figure 22B:
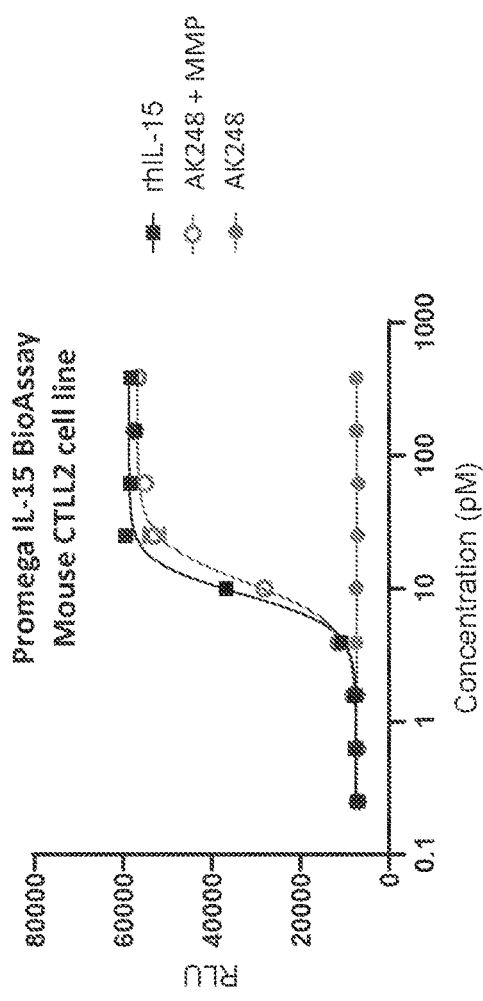

In some studies, HEK-Blue IL-2 reporter cells (Invivogen) were used to test activation of the JAK-STAT pathway in accordance with the following method. HEK-Blue IL-2 cells passage 6 (p6) (97% live) were washed 2× with assay medium (DMEM+10% heat-inactivated FBS), plated in 3 plated at 5e4 cells/well in 150 uL of assay medium, and rested in assay medium for about 2 hours to allow adherence to plate. Each construct tested was diluted to 300 pM in assay medium, then diluted 1:2 down the plate. 50 uL of each dilution was added, for a final starting concentration of 75 pM. HEK-Blue IL-2 cell supernatant was harvested after 24 hours, an incubated with Quantiblue (180 uL+20 uL supernatant), plus 3 wells/plate of assay medium, at 37 deg C. for 1 hour. The absorbance was read using a Biotek Neo2 at 625 nm. In one study, the exemplary masked IL-15 polypeptide construct AK248 was tested in accordance with this protocol, with or without prior exposure to an MMP10 protease, along with recombinant human IL-15 (rhIL-15) as a positive control. As shown in FIGS. 22A and 22B, there was no detectable activation of the JAK-STAT pathway when using the masked IL-15 polypeptide construct AK248 (without protease cleavage), but following cleavage by an activating protease, strong levels of activation of the JAK-STAT pathway were observed. This demonstrates that an exemplary IL-15 polypeptide can be effectively masked and also activated through protease cleavage.

In some studies, CTLL2 cells were used to test activation of the JAK-STAT pathway in accordance with the following method. CTLL2 cells were plated at 40,000 cell per well in RPMI with 10% FBS. Dilutions of the constructs of interest (e.g., the masked IL-15 polypeptide construct AK248, with or without prior exposure to an MMP protease, or a positive control such as rhIL-15) were added and incubated at 37 degrees. After 6 hours, the Bio-Glo reagent was added and luminescence measured with a BioTek Synergy Neo2 plate reader.

Receptor Binding

The binding of the masked IL-2 polypeptide constructs and the masked IL-15 polypeptide constructs generated in Example 1 is assessed. For the masked IL-2 polypeptide constructs, in some experiments, ELISA plates are coated with a receptor subunit, such as IL-2Rα (also referred to as CD25), IL-2Rβ (also referred to as CD122), or IL-2Rγ (also referred to as CD132), or combinations thereof. For the masked IL-15 polypeptide constructs, in some experiments, ELISA plates are coated with a receptor subunit, such as IL-15Rα, IL-2Rβ (also referred to as CD122), or IL-2Rγ (also referred to as CD132), or combinations thereof. Dilutions of masked IL-2 polypeptide constructs or masked IL-15 polypeptide constructs are allowed to bind to the receptor subunit(s) and are detected using an anti-huFc-HRP detection antibody. The binding of the masked IL-2 polypeptide constructs and masked IL-15 polypeptide constructs is determined in conditions with and without protease cleavage.

On-Cell Receptor Binding

The on-cell receptor binding of the masked IL-2 polypeptide constructs and the masked IL-15 polypeptide constructs generated in Example 1 is assessed. Dilutions of masked IL-2 polypeptide constructs or IL-15 polypeptide constructs are allowed to bind to peripheral blood lymphocytes or tissue culture cells, such as CTLL2 cells and are detected by fluorescence activated cell sorting (FACS) using an anti-huFc-FITC or anti-albumin-FITC detection antibody. The binding of the masked IL-2 polypeptide constructs and IL-15 polypeptide constructs is determined in conditions with and without protease cleavage.

Receptor Binding Affinity

The binding affinity of the masked IL-2 polypeptide constructs and the masked IL-15 polypeptide constructs generated in Example 1 is assessed. For example, surface plasmon resonance (SPR) is performed at room temperature and/or 37° C. The IL-2 receptors (e.g., IL-2Rα, IL-2Rβ, or IL-2Rγ, or combinations thereof) are coupled to CM5 chips (GE Healthcare) via EDC/NHS chemistry. The IL-15 receptors (e.g., IL-15Rα, IL-2Rβ, or IL-2Rγ, or combinations thereof) are coupled to CM5 chips (GE Healthcare) via EDC/NHS chemistry. Masked IL-2 polypeptide constructs or masked IL-15 polypeptide constructs are flowed over the chips at a range of concentrations to obtain dissociation constants for on- and off-rates. The binding affinity of the masked IL-2 polypeptide constructs and the IL-15 polypeptide constructs is determined in conditions with and without protease cleavage.

For some SPR studies testing binding of masked and non-masked IL-2 polypeptide constructs, Reichert Carboxymethyl Dextran Hydrogel Surface Sensor Chips were coated and immobilized with the construct of interest (e.g., a masked IL-2 polypeptide construct or non-masked IL-2 polypeptide construct) at 30 ug/ml in 10 mM Sodium Acetate, pH 5.0 diluted 1:1 in EDC and NHS. Dilutions of CD25-Fc or Fc-CD122 in PBS (CD25: 16 nM, 8 nM, 4 nM, 2 nM, 1 nM and CD122: 500 nM, 250 nM, 125 nM, 62.5 nM, 31.25 nM) were prepared. Using a Reichert 4Channel SPR, dilutions of CD25 or CD122 were flowed over the clips with the immobilized construct to determine the on rate at 25 degrees C. At equilibrium (approximately 3-4 minutes), the flow buffer was changed to PBS, to determine the off rates over 1 minute. Between each run the chip was regenerated with 10 mM glycine, pH 2.0. A similar approach is taken to test binding of masked and unmasked IL-15 polypeptide constructs to appropriate binding partners at appropriate concentrations in accordance with the teachings and examples herein.

Figures 9A, 9B, 9C:
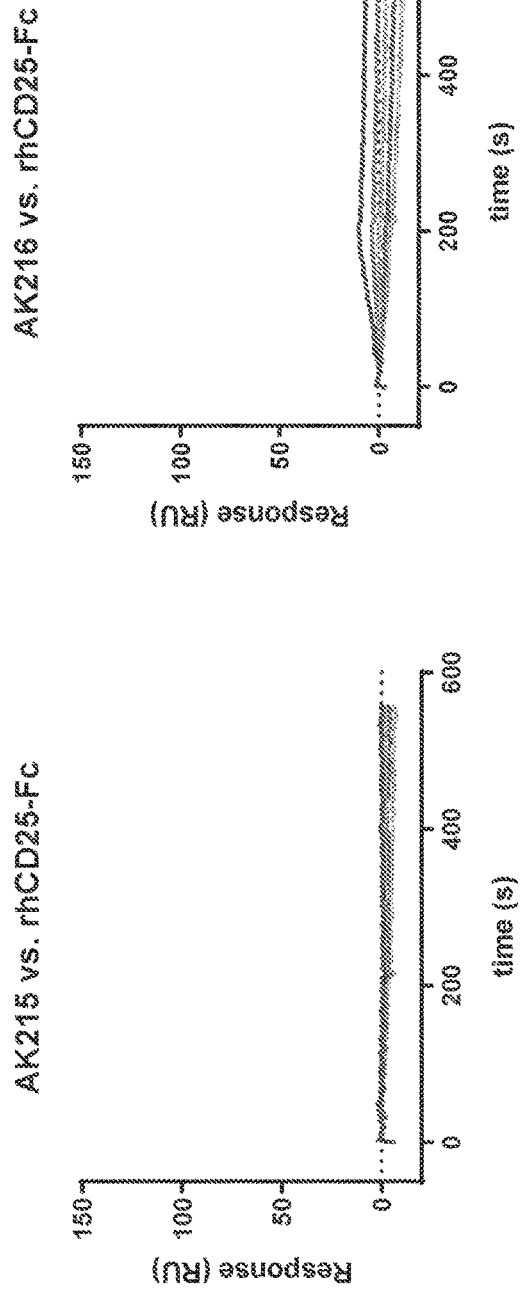
FIGS. 9A-9D shows results from SPR analysis that tested the binding of exemplary masked IL-2 polypeptide constructs (AK215 and AK216), or a rhIL2 control, to CD25-Fc.
Figure 9D:
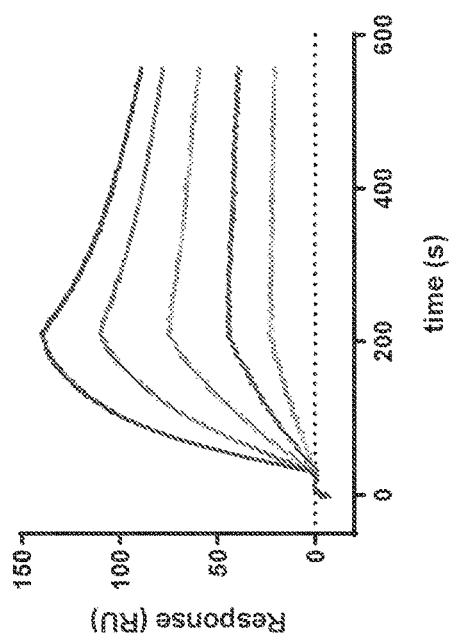

FIGS. 9A-9D depict results from SPR analysis that tested the binding of exemplary masked IL-2 polypeptide constructs (AK215 and AK216) to CD25-Fc. FIG. 9A depicts the interaction between AK215 and CD25-Fc, FIG. 9B depicts the interaction between AK216 and CD25-Fc, and FIG. 9C depicts the interaction between a recombinant human IL2 (rhIL2) control and CD25-Fc. FIG. 9D provides a table summarizing the data obtained for the association constant (ka), dissociation constant (kd), equilibrium dissociation constant (KD), as well as the $Chi^2$ value and U-value for each interaction. These results demonstrate that these exemplary masked IL-2 polypeptide constructs did not demonstrate detectable binding to CD25-Fc, while the rhIL2 control did demonstrate detectable binding.

FIGS. 10A-10D depict results from SPR analysis that tested the binding of exemplary masked IL-2 polypeptide constructs (AK216 and AK218) to CD122-Fc. FIG. 10A depicts the interaction between AK216 and CD122-Fc, FIG. 10B depicts the interaction between AK218 and CD122-Fc, and FIG. 10C depicts the interaction between a recombinant human IL2 (rhIL2) control and CD122-Fc. FIG. 10D provides a table summarizing the data obtained for the association constant (ka), dissociation constant (kd), equilibrium dissociation constant (KD), as well as the $Chi^2$ value and U-value for each interaction. These results demonstrate that these exemplary masked IL-2 polypeptide constructs did not demonstrate detectable binding to CD122-Fc, while the rhIL2 control did demonstrate detectable binding Additional exemplary SPR data is provided below in Table 13 for various constructs tested, including masked and non-masked constructs. For some structures, when applicable, the KD was determined for the construct with or without having been previously cleaved by a protease.

TABLE 13

| Construct | KD for CD25 (without protease cleavage) | KD for CD122 (without protease cleavage) | KD for CD122 (after protease cleavage) |
|---|---|---|---|
| rhIL2 | 1.2 nM | 124 nM | N/A |
| AK032 | 1.76 nM | 260 nM | N/A |
| AK033 | No binding detected | 368 nM* | N/A |
| AK034 | No binding detected | Not determined | N/A |
| AK035 | No binding detected | 110 nM | N/A |
| AK042 | No binding detected | 4.1 nM | N/A |
| AK049 | No binding detected | 4.67 nM | N/A |
| AK056 | No binding detected | Not determined | N/A |
| AK076 | 2.28 nM | No binding detected | |
| AK077 | 4.77 nM | No binding detected | |
| AK078 | 3.41 nM | No binding detected | |
| AK081 | 1.66 nM | 489 nM* | N/A |
| AK109 | 1.67 nM | No binding detected | 118 nM |
| AK110 | 0.911 nM | No binding detected | 195 nM |
| AK111 | 0.4 nM | No binding detected | 235 nM |
| AK112 | 0.724 nM | No binding detected | No binding detected |
| AK113 | No binding detected | 191 nM | 74.3 nM |
| AK114 | No binding detected | 10.2 nM | 13.8 nM |
| AK168 | No binding detected | Not determined | 175 nM |
| AK215 | No binding detected | | |
| AK216 | No binding detected | | |
| AK217 | 1.9 nM | | |
| AK218 | Weak binding | | |
| AK219 | Weak binding | | |
| AK220 | Weak or no binding detected | | |
| AK221 | Weak binding | | |
| AK222 | Weak or no binding detected | | |
| AK223 | No binding detected | | |
| AK224 | No binding detected | | |

Cleavage

The cleavage rate of the masked IL-2 polypeptide constructs is assessed by conducting receptor-binding assays, as described above, after incubation of the masked IL-2 peptide constructs in the presence or absence of a protease, and with the protease, if any, inactivated at various time points, such as by the addition of EDTA. The cleavage rate of the masked IL-15 polypeptide constructs is assessed by conducting receptor-binding assays, as described above, after incubation of the masked IL-15 peptide constructs in the presence or absence of a protease, and with the protease, if any, inactivated at various time points, such as by the addition of EDTA. The cleavage rate is also assessed using reducing and non-reducing polyacrylamide gel electrophoresis (PAGE) and by mass spectrometry whole mass and peptide map analyses. The cleavage rate is also assessed using an ex vivo assay in which the masked IL-2 polypeptide constructs or the masked IL-15 polypeptide constructs are exposed to human, mouse, or cynomolgus monkey peripheral blood lymphocytes, or normal human tissue or human tumor tissue.

For some protease activation studies, MMP10 was diluted to 50 ng/uL in MMP cleavage buffer and activated with 1 mM APMA for 2 h at 37° C. 5 µL of protease (250 ng total) of the activated protease was incubated with 1 uM of masked cytokine constructs (e.g., masked IL-2 polypeptide constructs) and incubated at 37 degrees for 2 hours. Cleavage was assessed by SDS-PAGE using AnykD™ Criterion™ TGX Stain-Free™ Protein Gels. A similar approach is taken to test cleavage by other proteases.

Figure 11A:
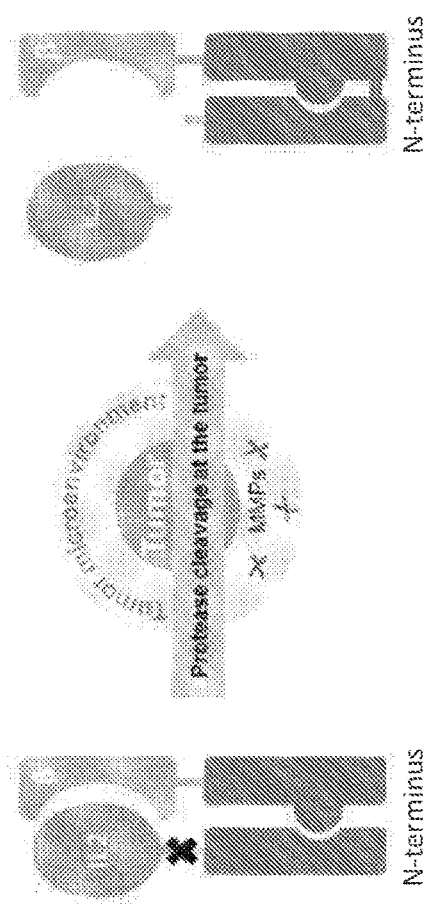
FIG. 11A shows an exemplary embodiment of a masked cytokines prior to (left) and after (right) cleavage by a protease, such as at the tumor microenvironment.
Figure 11B:
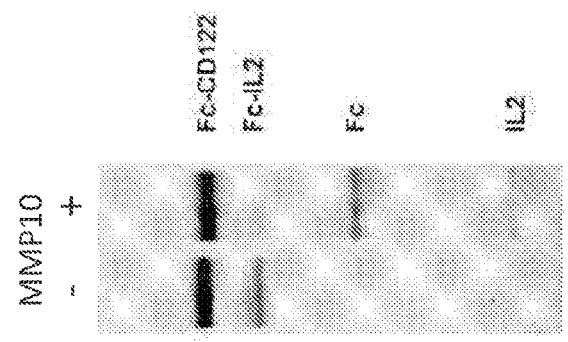
FIG. 11B shows SDS-PAGE analysis of an exemplary masked IL-2 polypeptide construct that was incubated in the absence (left lane) or presence (right lane) of the MMP10 protease, which demonstrates the release of IL-2 from the Fc portion.
Figure 12A:
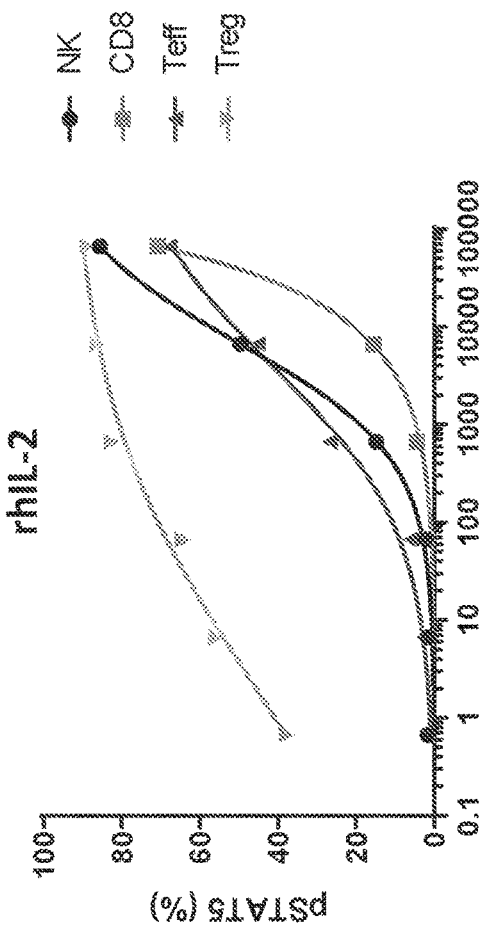
FIGS. 12A-12D shows STAT5 activation (%) in PBMCs treated with the construct AK032, AK035, AK041, or rhIL-2 as a control. The levels of STAT5 activation (%) are shown for NK cells, CD8+ T cells, effector T cells (Teff), and regulatory T cells (Treg), as determined following incubation with rhIL-2 (FIG. 12A), AK032 (FIG. 12B), AK035 (FIG. 12C), or AK041 (FIG. 12D).
Figure 12B:
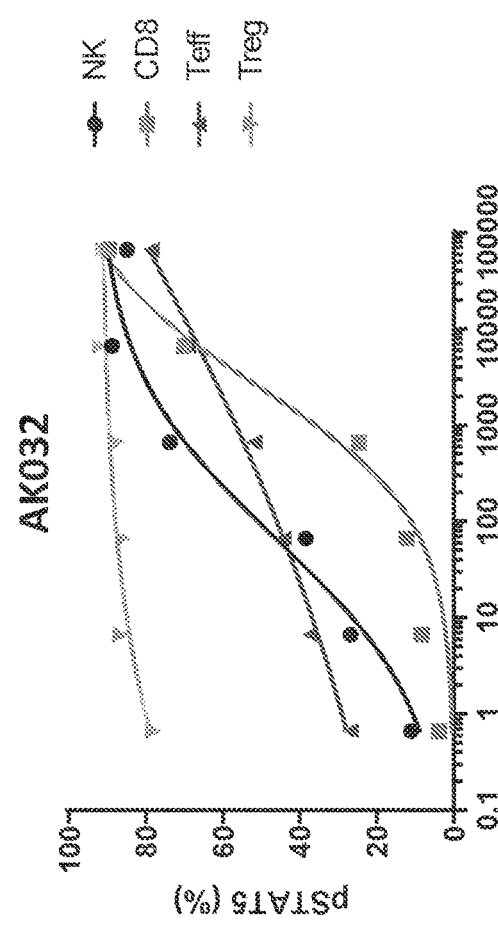
Figure 12C:
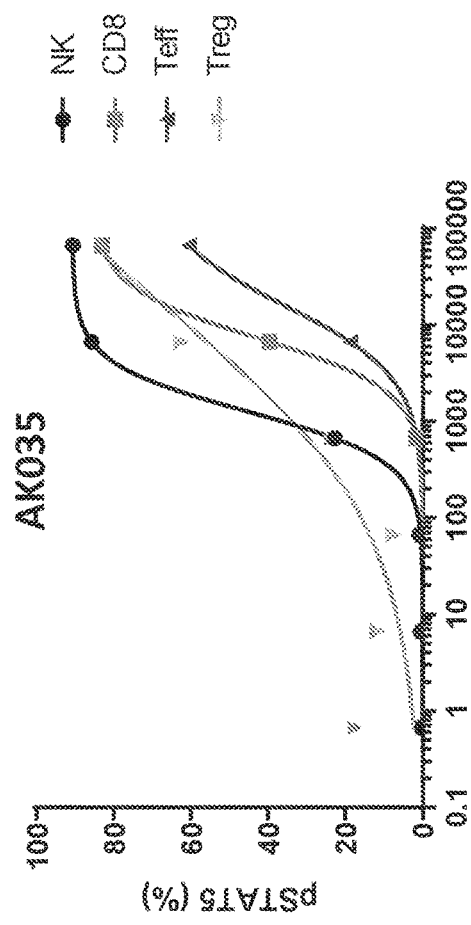
Figure 12D:
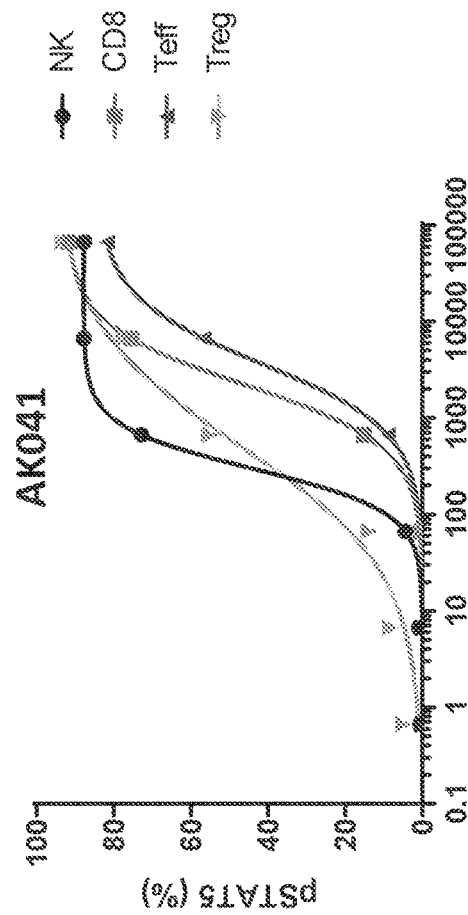

FIG. 11A depicts an exemplary structure of a masked IL-2 polypeptide prior to (left) and after (right) cleavage by a protease, such as a protease associated with the tumor environment. FIG. 11B depicts SDS-PAGE analysis of an exemplary masked IL-2 polypeptide construct that was incubated in the absence (left lane) or presence (right lane) of the MMP10 protease.

Proliferation

Proliferation of IL-2 and IL-15 responsive tissue culture cell lines, such as CTLL2, YT, TF1B, LGL, HH, and CT6, following treatment with the masked IL-2 polypeptide constructs or the masked IL-15 polypeptide constructs generated in Example 1 is assessed. For experiments involving the masked IL-2 polypeptide constructs, cells are plated in 96 well tissue culture plates in media lacking IL-2 for 2-4 hours and then treated with the masked IL-2 polypeptide constructs at various concentrations. For experiments involving the masked IL-15 polypeptide constructs, cells are plated in 96 well tissue culture plates in media lacking IL-15 for 2-4 hours and then treated with the masked IL-15 polypeptide constructs at various concentrations. After incubation at 37 degrees for 24-48 hours, the cell number is determined by the addition of MTS, alamar blue, luciferase, or a similar metabolic detection reagent, and the colorimetric, fluorescent or luciferase readout detected by a plate spectrophotometer reader.

The proliferation of immune cells following treatment with the masked IL-2 polypeptide constructs or the masked IL-15 polypeptide constructs generated in Example 1 is also assessed. Human, mouse, or cynomolgus peripheral blood mononuclear cells (PBMCs) are treated with the constructs at various concentrations, and the proliferation of cell types, such as Natural Killer (NK) cells, CD8+ T cells, CD4+ T cells, and/or Treg cells, is determined by staining for the particular cell type and analysis via fluorescence activated cell sorting (FACS). In some experiments, some PBMCs are treated with controls for comparison. In some experiments, some PBMCs are treated with aldesleukin as a control for the masked IL-2 polypeptide treatment. In some experiments, the masked IL-2 polypeptide constructs and the masked IL-15 polypeptide constructs are tested in conditions with and without protease cleavage (e.g., activation). In some experiments, the NK cells are stained as CD45+ CD3− CD56+, the CD8+ T cells are stained as CD45+ CD3+ CD8+, the CD4+ T cells are stained as CD45+ CD3+ CD4+ CD25−, and the Treg cells are stained as CD45+ CD3+ CD4+ CD25+ FOXP3+. In some experiments, the PBMCs are treated for a period of five days. In some experiments, the PBMCs are also stained with Ki67, a marker of cell proliferation. In some experiments, the PBMCs are labeled with CFSE (Sigma-Aldrich) prior to treatment and proliferation is measured by determining the extent of CFSE dilution. In some experiments, each construct, as well as aldesleukin and/or other controls, is administered at one or more concentrations, such as one or more concentrations ranging from 0.0001 nM to 500 nM.

STAT5 Activation

The activation of Signal Transducer and Activator of Transcription 5 (STAT5) following treatment with the masked IL-2 polypeptide constructs or the masked IL-15 polypeptide constructs generated in Example 1 is also assessed. PBMCs are treated with the constructs for a specified period of time and are then immediately fixed to preserve the phosphorylation status of proteins, such as STAT5. In some experiments, some PBMCs are treated with controls for comparison. In some experiments, some PBMCs are treated with aldesleukin as a control for the masked IL-2 polypeptide treatment. In some experiments, the masked IL-2 polypeptide constructs and the masked IL-15 polypeptide constructs are tested in conditions with and without protease cleavage (e.g., activation). In some experiments, the PBMCs are treated for 10 minutes, 15 minutes, 20 minutes, or 25 minutes. In some experiments, each construct, as well as aldesleukin and/or other controls, is administered at one or more concentrations, such as one or more concentrations ranging from 0.0001 nM to 500 nM. In some experiments, the fixed and permeabilized PBMCs are then stained with an antibody specific for phosphorylated STAT5 (phospho-STAT5) and are analyzed by flow cytometry. In some experiments, total and phosphorylated levels of STAT5 are measured. The phospho-STAT5 status of certain cell types, such as NK cells, CD8+ T cells, CD4+ T cells, and/or Treg cells, is determined by staining for the particular cell type. In some experiments, the NK cells are stained as CD45+ CD3− CD56+, the CD8+ T cells are stained as CD45+ CD3+ CD8+, the CD4+ T cells are stained as CD45+ CD3+ CD4+ CD25−, and the Treg cells are stained as CD45+ CD3+ CD4+ CD25+ FOXP3+.

The activation of STAT5 in the mouse cell lines, such as CTLL-2 cells, following treatment with the masked IL-2 polypeptide constructs or the masked IL-15 polypeptide constructs generated in Example 1 is also assessed. In some experiments, some CTLL-2 cells are treated with controls for comparison. In some experiments, some CTLL-2 cells are treated with aldesleukin as a control for the masked IL-2 polypeptide treatment. In some experiments, the masked IL-2 polypeptide constructs and the masked IL-15 polypeptide constructs are tested in conditions with and without protease cleavage (e.g., activation). In some experiments, the CTLL-2 cells are treated for 10 minutes, 15 minutes, 20 minutes, or 25 minutes, and are then fixed to preserve the phosphorylation status of proteins, such as STAT5. In some experiments, each construct, as well as aldesleukin and/or other controls, is administered at one or more concentrations. In some experiments, total and phosphorylated levels of STAT5 are measured.

In some studies, the levels of intracellular STAT5 activation (pSTAT5 signal) induced by IL-2 was determined by the following method. Frozen human PBMCs were thawed in water bath and added to 39 mL pre-warmed media (RPMI1640 medium plus 10% FBS, 1% P/S, 1% NEA), spun and reconstitute in media at 10E6 cells/mL. Cells were plated at 5E5 per well cells in a 96 well plate. IL-2 (e.g., rhIL-2 or an exemplary IL-2-containing polypeptide construct) diluted in medium was added to each well, and incubated at 37° C. for 20 min. Cells were then fix with 200 ul/well Fixation buffer (eBiosciences) at 4° C., overnight. After centrifugation, the fixed cells were resuspended in 200 ul cold BD Phosflow buffer and incubated at 4° C. for 30 min. After washing the cells twice, they were treated with Biolegend Human TruStain FcX (2.5 uL in 50 uL total per sample in Staining buffer) for 5 min on ice. Staining antibodies were added; 5 ul pSTAT5-APC (pY694, BD), 10 ul CD56-BV421 (5.1H11, Biolegend), 10 ul CD4-PerCP/Cy5.5 (A161A1, Biolegend), and 10 ul CD3-FITC (UCHT1, Biolegend) and incubated for 30 min, on ice, protected from light. Cells were washed 2 times and resuspended, and analyzed by flow cytometry.

FIGS. 12A-12D depict the results from STAT5 activation studies, as described above, using the exemplary constructs AK032, AK035, AK041, or rhIL-2 as a control. The levels of STAT5 activation (%) are shown for NK cells, CD8+ T cells, effector T cells (Teff), and regulatory T cells (Treg). The AK032 and AK035 constructs include an IL-2 polypeptide linked to an Fc domain, and the AK041 construct includes an IL-2 polypeptide linked to a CD25 domain and a CD122 domain. As shown, engineered IL-2 polypeptide constructs can, in some embodiments, reduce activation of Treg cells while retaining or enhancing activation of CD8+ T cells and NK cells.

FIGS. 13A-13C depict the results from STAT5 activation studies, as described above, using the exemplary constructs AK081 and AK032. The AK081 construct with and without prior exposure to MMP10 was tested. An isotype control as well as a no IL-2 negative control was also tested. The levels of STAT5 activation (%) are shown for NK cells, CD8+ T cells, and CD4+ T cells. The AK032 and AK081 constructs include an IL-2 polypeptide linked to an Fc domain, and the AK081 construct includes a cleavable peptide in the linker connecting the IL-2 polypeptide to the Fc domain. As shown, the non-masked monomeric AK081 IL-2 polypeptide construct stimulates STAT5 activation of PBMCs with or without protease activation similarly to the non-masked dimeric AK032 IL-2 polypeptide construct.

Figure 14A:
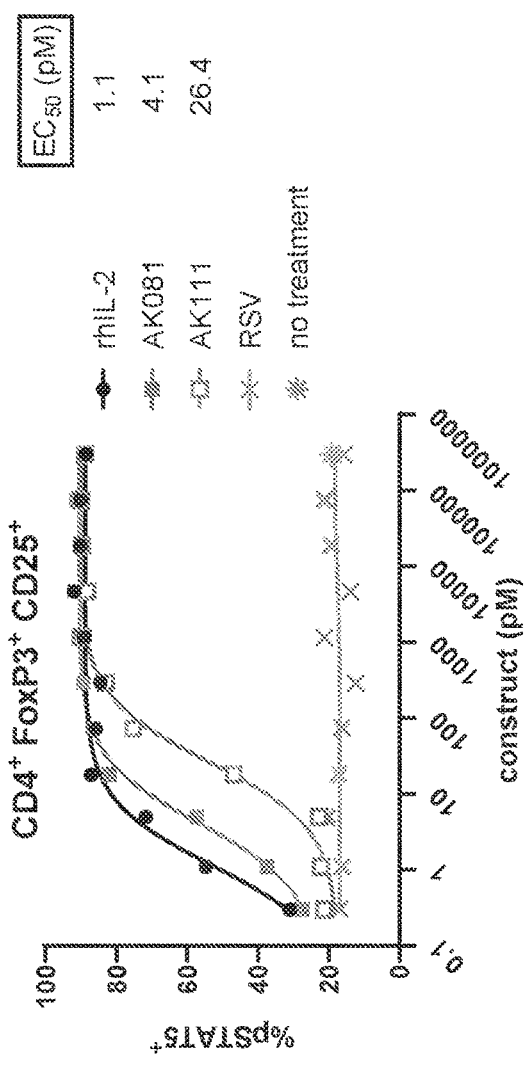
FIGS. 14A-14D shows the results from STAT5 activation studies in PBMCs using constructs AK081 and AK111, as well as controls that included an rhIL-2 and anti-RSV antibody. A no-treatment control was also tested. EC50 (pM) is also shown for the rhIL-2, AK081, and AK111 treatments. STAT5 activation (%) is shown for CD4+FoxP3+CD25+ cells (FIG. 14A), CD8+ cells (FIG. 14B), and CD4+FoxP3−CD25− cells (FIG. 14C).
Figure 14B:
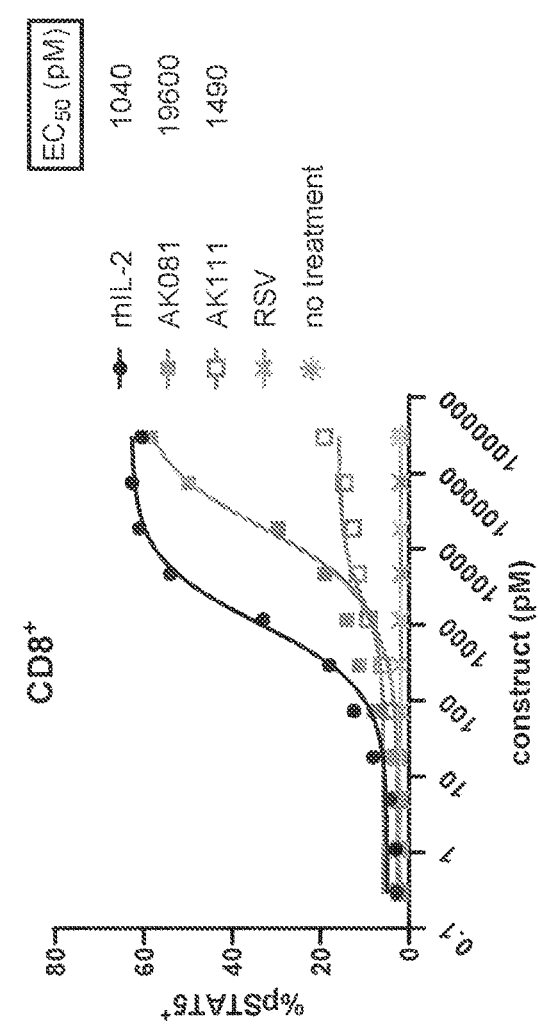
Figures 14C, 14D:
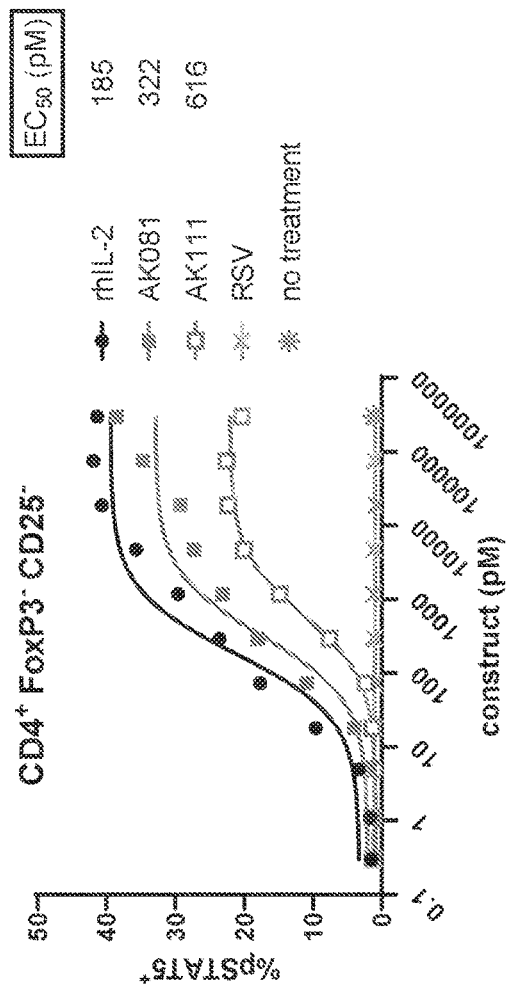

FIGS. 14A-14D depict the results from STAT5 activation studies, as described above, using the exemplary constructs AK081 and AK111, as well as controls that included an rhIL-2 and anti-RSV antibody. A no-treatment control was also tested. The AK111 construct is an exemplary masked IL-2 polypeptide construct that includes a wildtype form of an IL-2 polypeptide (except for a C125A mutation). As shown in FIGS. 14A-14C, the masked IL-2 polypeptide construct AK111 demonstrated reduced STAT5 activation as compared to the non-masked IL-2 polypeptide construct AK081. FIG. 14D provides EC50 (pM) and fold-change data for the AK081, AK111 constructs, as well as the rhIL-2 control.

Figure 15A:
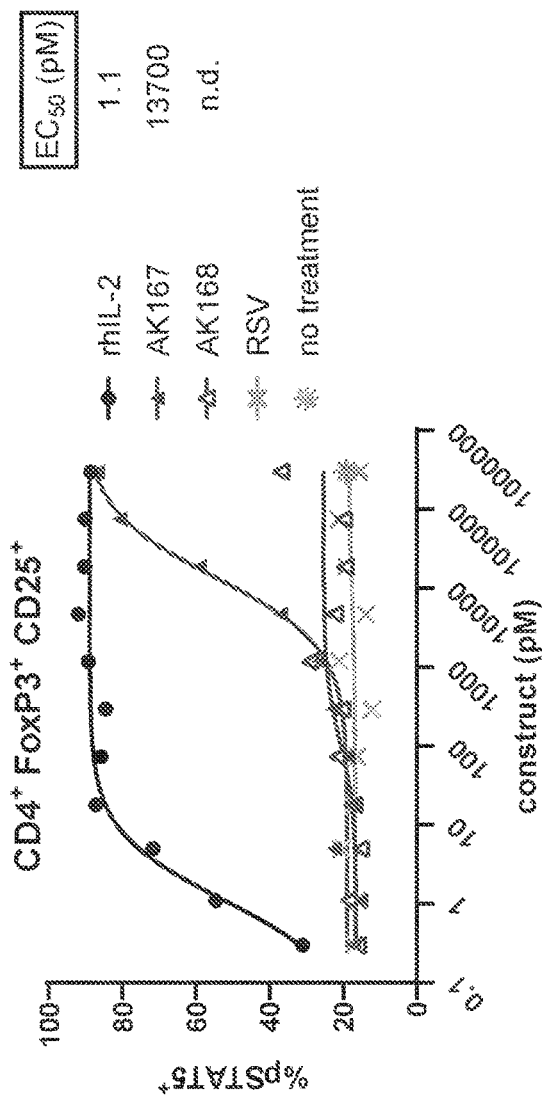
FIGS. 15A-15D shows the results from STAT5 activation studies in PBMCs using constructs AK167 and AK168, as well as controls that included an rhIL-2 and anti-RSV antibody. A no-treatment control was also tested. EC50 (pM) is also shown for the rhIL-2, AK167, and AK168 treatments. STAT5 activation (%) is shown for CD4+FoxP3+CD25+ cells (FIG. 15A), CD8+ cells (FIG. 15B), and CD4+FoxP3−CD25− cells (FIG. 15C).
Figure 15B:
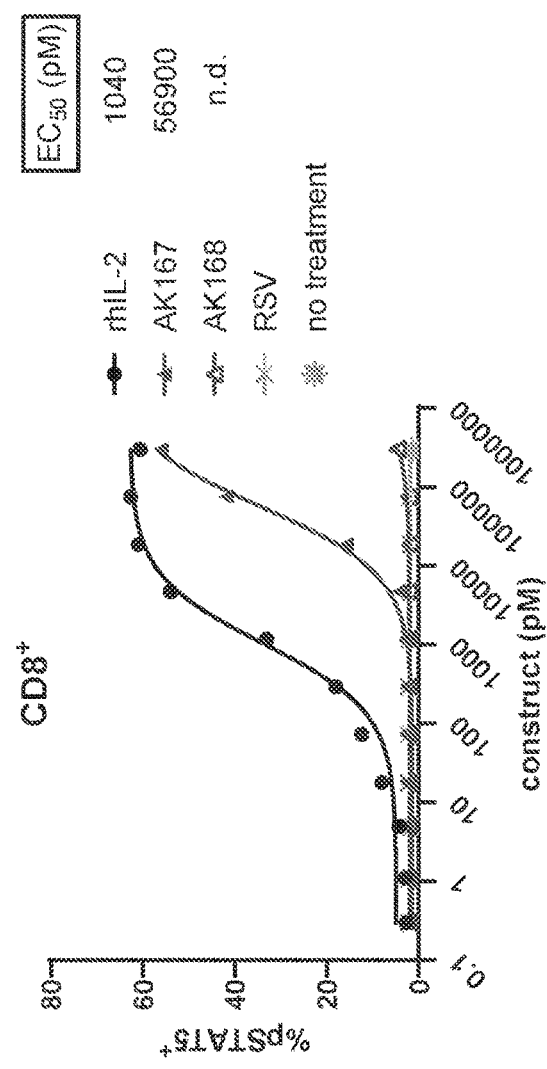
Figures 15C, 15D:
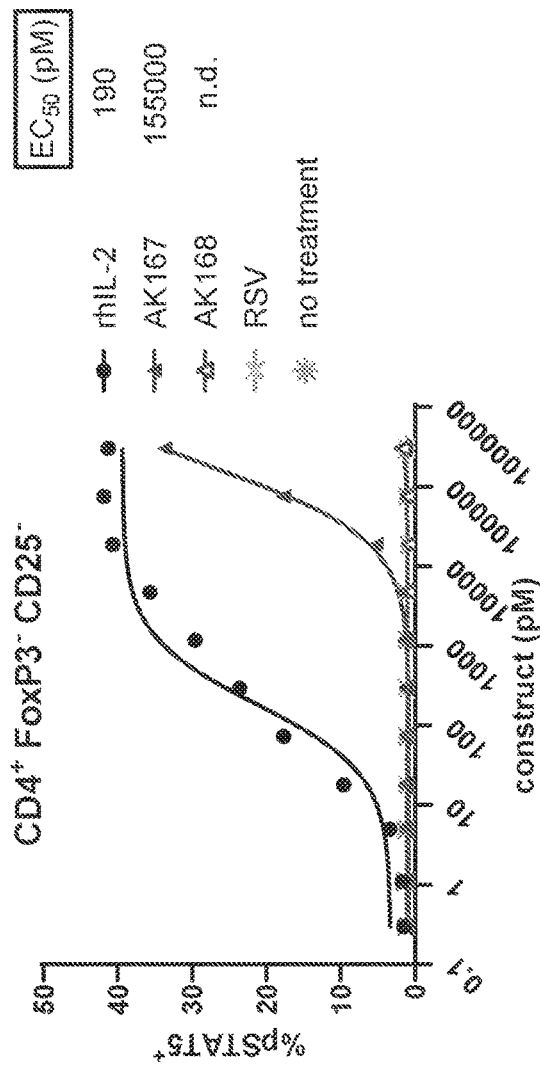

FIGS. 15A-15D depict the results from STAT5 activation studies, as described above, using the exemplary constructs AK167 and AK168, as well as controls that included an rhIL-2 and anti-RSV antibody. A no-treatment control was also tested. The AK168 construct is an exemplary masked IL-2 polypeptide construct that includes a mutant form of an IL-2 polypeptide that eliminates or reduces CD25 binding The AK167 construct is a parental, non-masked form of the AK168 construct that includes the same mutant IL-2 polypeptide. As shown in FIGS. 15A-15C, the non-masked AK167 construct demonstrated reduced STAT5 activation as compared to the rhIL-2 control, and the masked IL-2 polypeptide construct AK168 did not induce detectable STAT5 activation. FIG. 15D provides EC50 (pM) and fold-change data for the AK167, AK168 constructs, as well as the rhIL-2 control. The EC50 of the AK168 construct was non-detectable (n.d.).

Figure 16A:
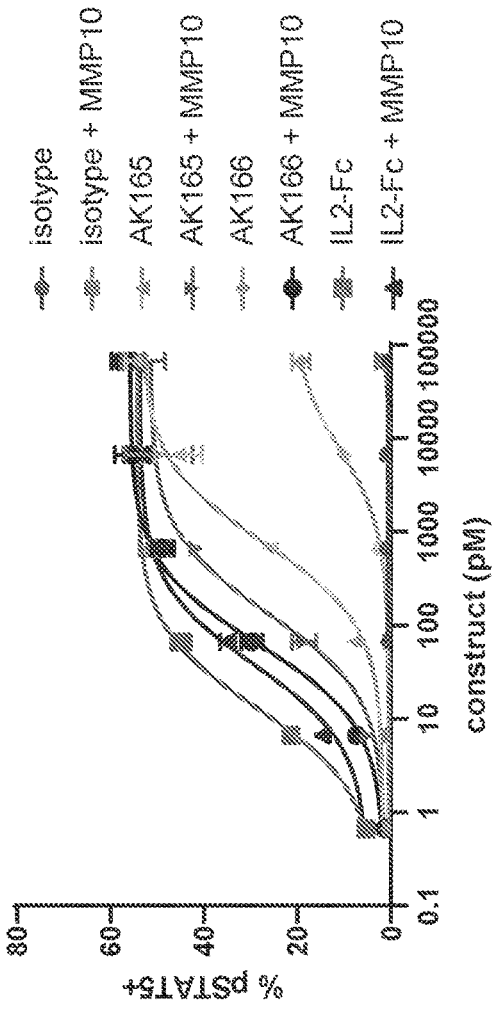
FIGS. 16A-16D shows STAT5 activation (%) in PBMCs treated with the construct AK165 or AK166, or an isotype control or an IL-2-Fc control, that were (+MMP10) or were not previously exposed to the MMP10 protease. The key as shown in FIG. 16A also applies to FIG. 16B, and the key as shown in FIG. 16C also applies to FIG. 16D. STAT5 activation (%) is shown for CD4+FoxP3+ T regulatory cells (FIG. 16A), CD4+FoxP3− T helper cells (FIG. 16B), CD8+ cytotoxic T cells (FIG. 16C), and CD56+ NK cells (FIG. 16D).
Figure 16B:
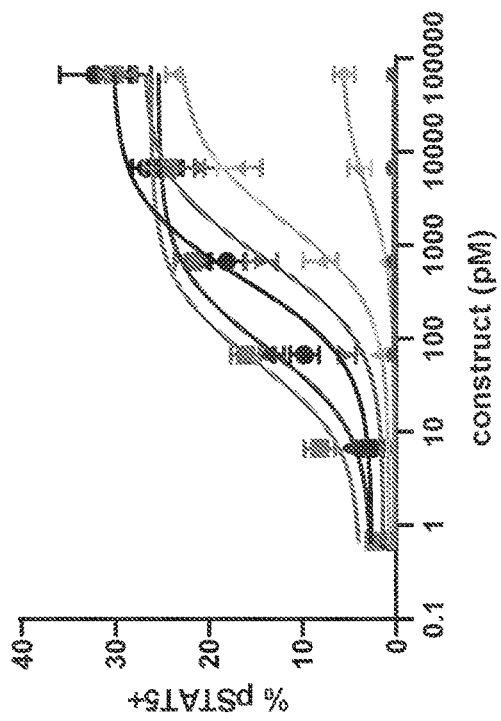
Figure 16C:
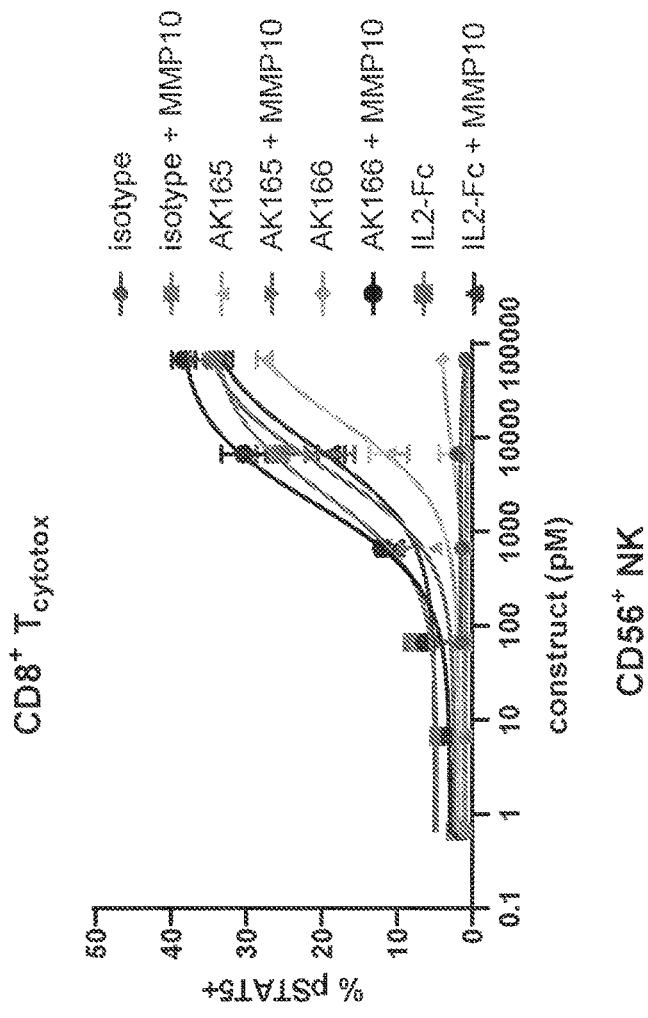
Figure 16D:
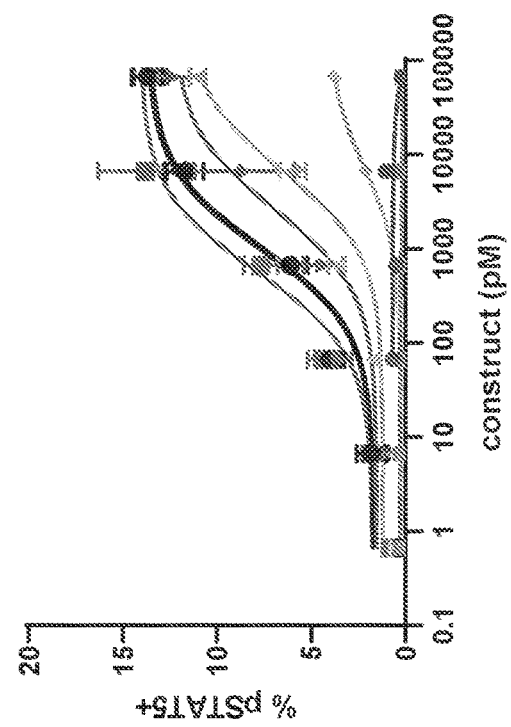

FIGS. 16A-16D depict the results from STAT5 activation studies, as described above, using the exemplary constructs AK165 and AK166, as well as an isotype control and an IL-2-Fc control, that were (+MMP10) or were not previously exposed to the MMP10 protease. The AK166 construct is an exemplary masked IL-2 polypeptide construct that includes a wildtype form of an IL-2 polypeptide (except for a C125A mutation). The AK165 construct is a parental, non-masked form of the AK166 construct that includes the same IL-2 polypeptide. The key as shown in FIG. 16A also applies to FIG. 16B, and the key as shown in FIG. 16C also applies to FIG. 16D. As shown in FIGS. 16A-16D, STAT5 activation was greatly diminished for the masked AK166 construct (without protease cleavage), but was restored to levels resembling the IL2-Fc control following exposure to the activating protease MMP10.

FIGS. 17A-17C depict the results from STAT5 activation studies, as described above, using the exemplary constructs AK109 and AK110, as well as an isotype control and an IL-2-Fc control, that were (+MMP10) or were not previously exposed to the MMP10 protease. The AK109 and AK110 construct are exemplary masked IL-2 polypeptide constructs that include half-life extension domains having different heterodimerization mutations. The key as shown in FIG. 17B also applies to FIG. 17A. As shown in FIGS. 17A-17C, STAT5 activation was greatly diminished for the masked AK109 and AK110 construct (without protease cleavage), but was greatly increased to levels approaching the IL2-Fc control following exposure to the activating protease MMP10.

Figures 18A, 18B:
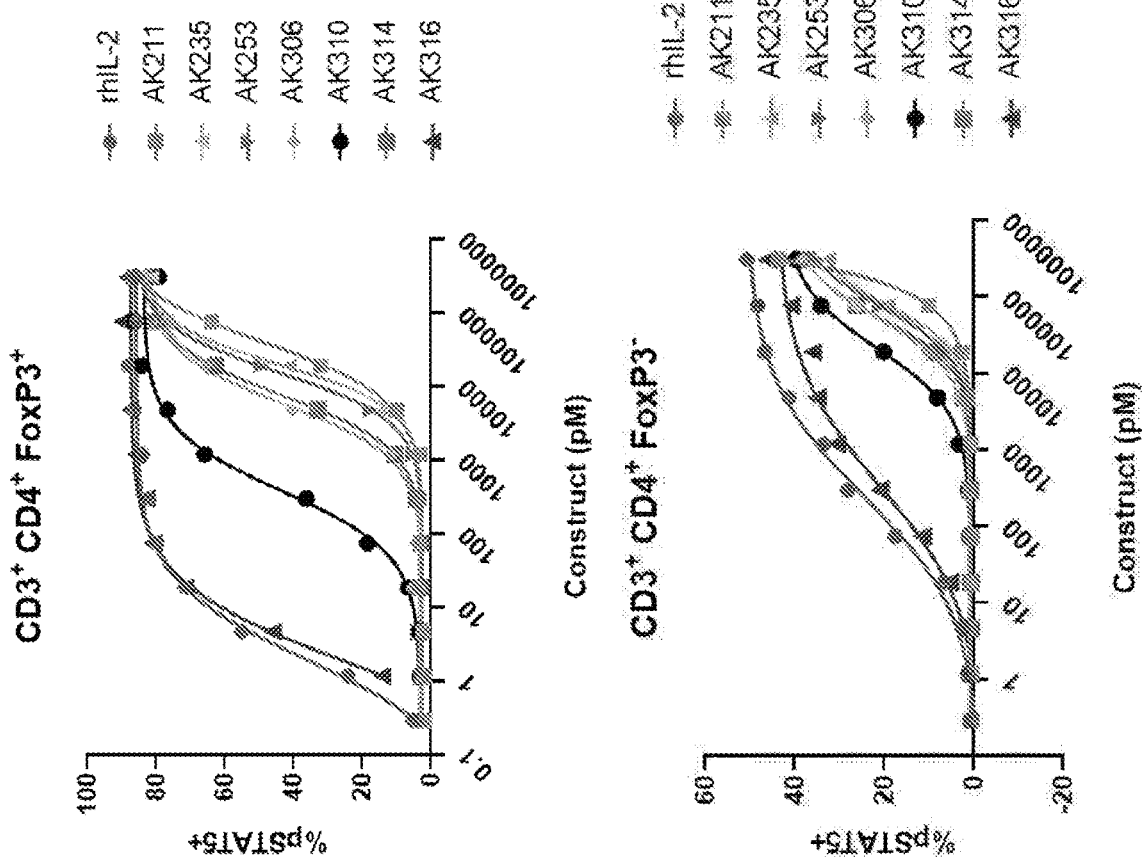
FIGS. 18A-18D shows the results from STAT5 activation studies in PBMCs using the constructs AK211, AK235, AK253, AK306, AK310, AK314, and AK316, as well as an an rhIL-2 control. STAT5 activation (%) is shown for CD3+CD4+FoxP3+ cells (FIG. 18A), CD3+CD4+FoxP3− cells (FIG. 18B), and CD3+CD8+ cells (FIG. 18C).
Figures 18C, 18D:
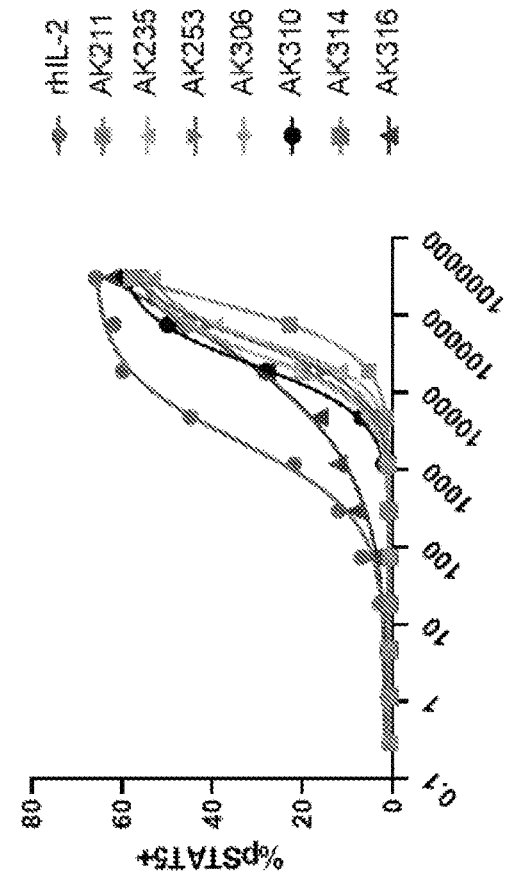

FIGS. 18A-18D depict the results from STAT5 activation studies, as described above, using the constructs AK211, AK235, AK253, AK306, AK310, AK314, and AK316, as well as an rhIL-2 control. This includes constructs that are parental, non-masked constructs (AK235, AK253, AK306, AK310, AK314) that include various mutations that modulate CD25 binding. FIG. 18D provides EC50 data for each of the tested constructs as well as the rhIL-2 control.

Figure 19A:
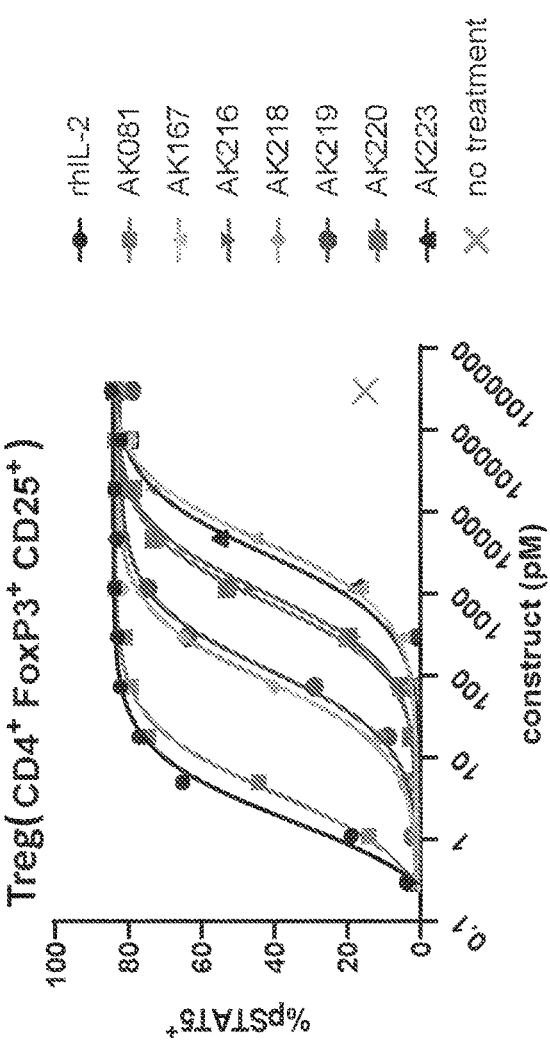
FIGS. 19A-19D shows the results from STAT5 activation studies in PBMCs using the constructs AK081, AK167, AK216, AK218, AK219, AK220, and AK223 that have been activated by protease, as well as an rhIL-2 control. STAT5 activation (%) is shown for CD4+FoxP3+CD25+ regulatory T cells (FIG. 19A), CD4+FoxP3−CD25− cells (FIG. 19B), and CD8+ cells (FIG. 19C).
Figure 19B:
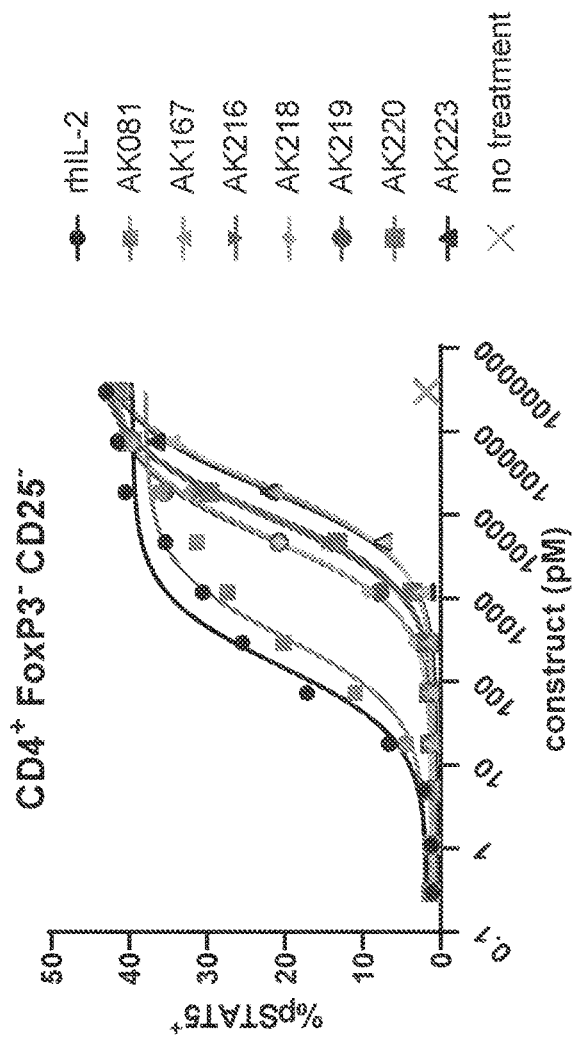
Figures 19C, 19D:
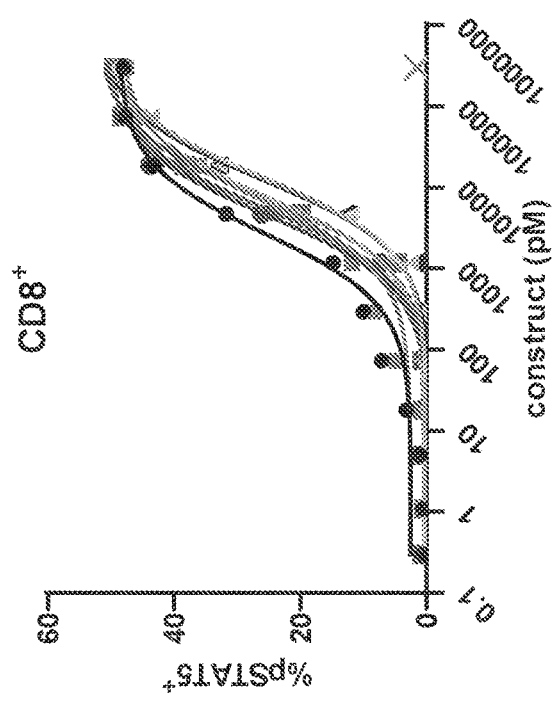

FIGS. 19A-19D depict the results from STAT5 activation studies, as described above, using the constructs AK081, AK167, AK216, AK218, AK219, AK220, and AK223 that have been activated by protease, as well as an rhIL-2 control. A no-treatment control was also tested. This includes masked IL-2 polypeptide constructs (AK216, AK218, AK219, AK220, and AK223) that include various mutations that modulate CD25 binding. The constructs were previously exposed to an activating protease prior to testing their ability to activate STAT5. FIG. 19D provides EC50 data for each of the tested constructs as well as the rhIL-2 control.

FIGS. 20A-20C depict the results from STAT5 activation studies, as described above, using the constructs AK081, AK189, AK190, and AK210, as well as an anti-RSV control. This includes masked IL-2 polypeptide constructs (AK189, AK190, AK210) that include an IL-2 polypeptide having a C125A mutation and include the same cleavable peptide sequence (RAAAVKSP; SEQ ID NO: 121) but having different linker sequences due to differences in the amino acid residues on the N-terminus of the protease cleavage sequence. The key as shown in FIG. 20A also applies to FIGS. 20B and 20C.

Figure 21A:
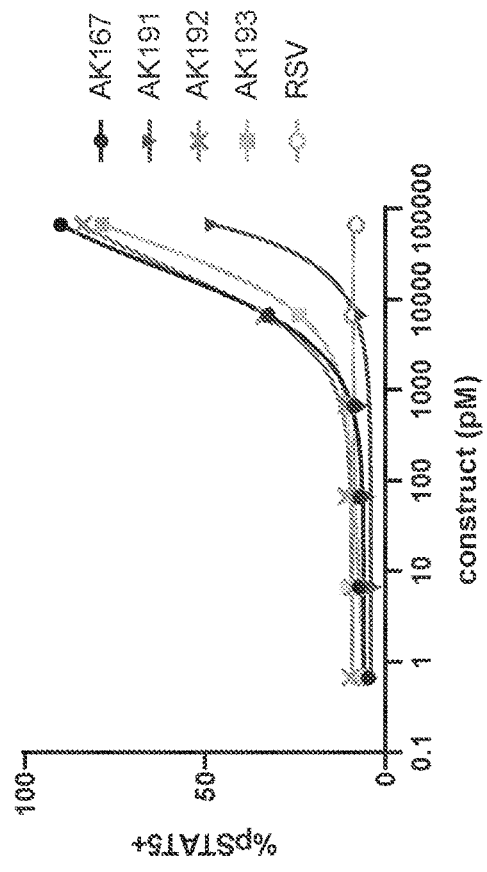
FIGS. 21A-21C shows STAT5 activation (%) in PBMCs treated with the construct AK167, AK191, AK192, or AK193, or an anti-RSV control. The key as shown in FIG. 21A also applies to FIGS. 21B and 21C. STAT5 activation (%) is shown for regulatory T cells (FIG. 21A), CD4 helper T cells (FIG. 21B), and CD8 cells (FIG. 21C).
Figure 21C:
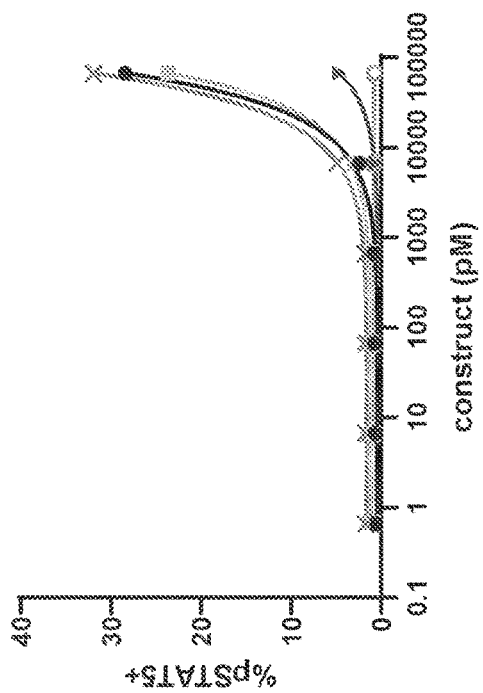
Figure 21B:
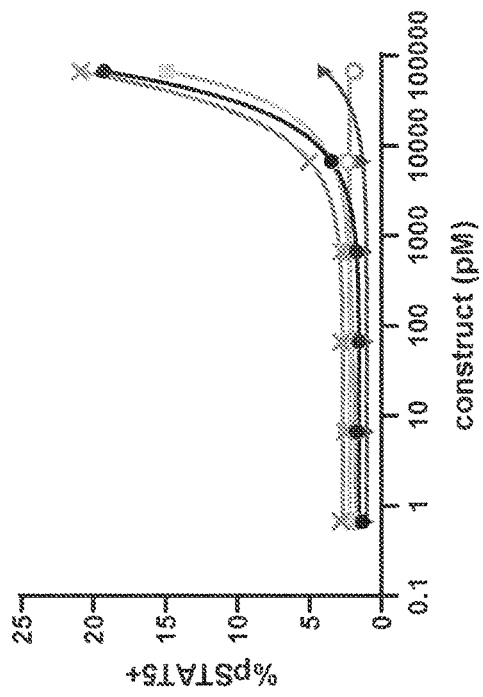

FIGS. 21A-21C depict the results from STAT5 activation studies, as described above, using the constructs AK167, AK191, AK192, and AK193, as well as an anti-RSV control. This includes masked IL-2 polypeptide constructs (AK189, AK190, AK210) that include an IL-2 polypeptide having R38A, F42A, Y45A, E62A, and C125A mutations and include the same cleavable peptide sequence (RAAAVKSP; SEQ ID NO: 121) but having different linker sequences due to differences in the amino acid residues on the N-terminus of the protease cleavage sequence. The key as shown in FIG. 21A also applies to FIGS. 20B and 20C.

Example 3: In Vivo Characterization of Masked IL-2 and IL-15 Polypeptides Pharmacokinetics The pharmacokinetics of the masked IL-2 polypeptide constructs and the masked IL-15 polypeptide constructs generated in Example 1 is assessed in vivo using mouse models.

Mice are treated intravenously or subcutaneously with the constructs and the concentration of the construct in the plasma is measured over time. In some experiments, some mice are treated with controls for comparison. In some experiments, some mice are treated with aldesleukin as a control for masked IL-2 polypeptide treatment. In some experiments, the mice that are treated have tumors. In some experiments, the mice that are treated are tumor-free. In some experiments, mice are treated with the constructs and blood is drawn at various times over the course of treatment, which may include drawing blood prior to the initiation of treatment and processing it to obtain plasma. In some experiments, blood is drawn at various time points over the course of two weeks, three weeks, or four weeks or more of treatment. In some experiments, the mean plasma concentration of the administered constructs, as well as aldesleukin and/or other controls, is measured. Masked IL-2 polypeptide constructs are detected in the plasma samples after dilution into PBS Tween with IL-2- and human Fc-specific ELISAs and are quantified using a standard curve generated for each construct. Masked IL-15 polypeptide constructs are detected in the plasma samples after dilution into PBS Tween with IL-15- and human Fc-specific ELISAs and are quantified using a standard curve generated for each construct. The percentage of full length and cleaved constructs is determined by western blot with anti-huFc-HRP and anti-huIL-2-HRP and by whole mass and peptide mass spectrometry.

The pharmacokinetics of the masked IL-2 polypeptide constructs and the masked IL-15 polypeptide constructs in tumors is also assessed in vivo using mouse models. Mice having tumors are treated intravenously or subcutaneously with the constructs and the concentration of the construct in tumors of the mice is assessed. In some experiments, some mice are treated with controls for comparison. In some experiments, some mice are treated with aldesleukin as a control for masked IL-2 polypeptide treatment. Tumors are analyzed for the presence of the constructs as well as the presence of particular proteases. In some experiments, the tumors are analyzed for the presence and percentage of full length and cleaved constructs.

Some pharmacokinetic studies were carried out according to the following method. C57BL/6 female mice were purchased from Charles River Laboratories and were 8-10 weeks old at the start of study. MC38 tumor cells ($5 \times 10^5$ cells per mouse) were injected subcutaneously into the right flank of each mouse. Upon reaching ~100 mm³ sized tumors (day 0), the mice received a single 2 mg/kg intravenous dose of the construct of interest (e.g., a non-masked parental IL-2 polypeptide construct, a masked IL-2 polypeptide construct, or a non-cleavable masked IL-2 polypeptide construct) in PBS. Constructs tested include, for instance, AK032, AK081, AK111, AK167, AK168, AK191, AK197, AK203, AK209, and AK211. Plasma were collected at 5 min, days 1, 2 and 5 after dosing. Drug levels were determined using ELISAs utilizing anti-human IgG (clone M1310G05, Biolegend) as the capture antibody and various detection antibodies. HRP or biotin conjugated detection antibodies against human IgG (ab97225, Abcam) or CD122 (clone 9A2, Ancell) and IL-2 (Poly5176, Biolegend) were utilized to detect total and non-cleaved drug levels, respectively.

Figure 23A:
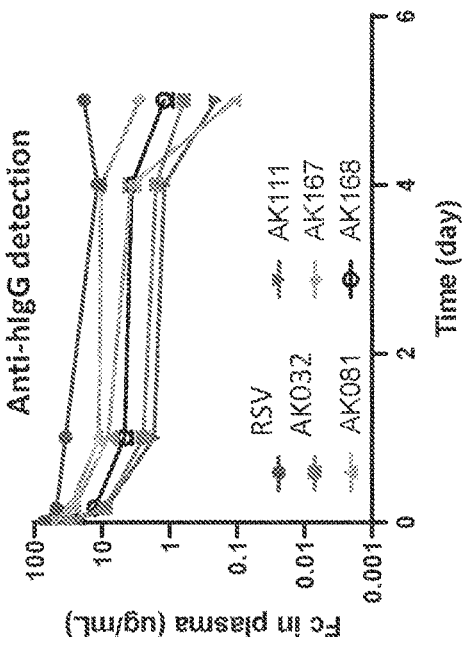
FIGS. 23A-23D show results from pharmacokinetic studies carried out in tumor-bearing mice using the construct AK032, AK081, AK111, AK167, or AK168, or an anti-RSV control.
Figure 23B:
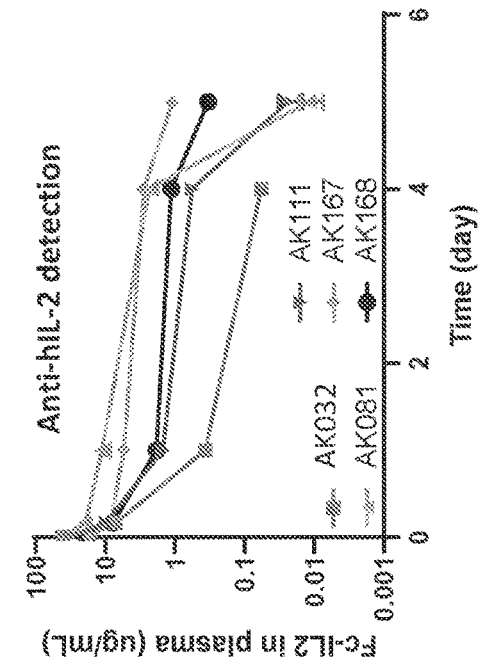
Figure 23C:
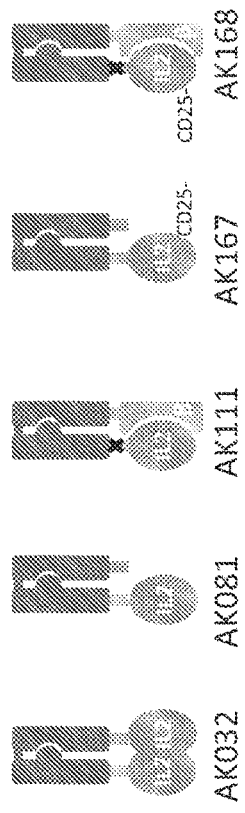
Figure 23D:
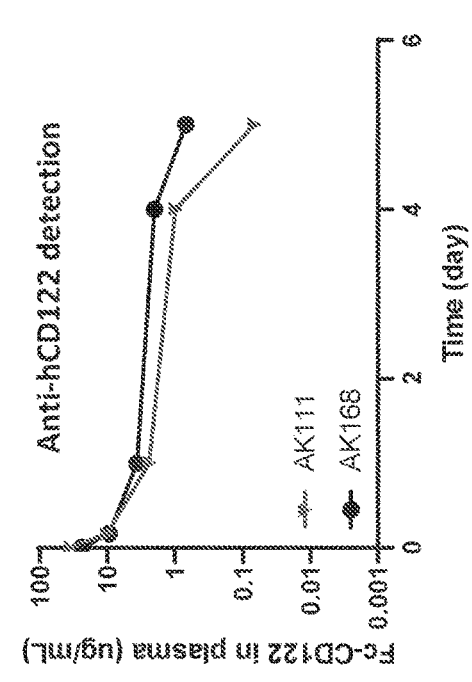

FIGS. 23A-23D describe results from pharmacokinetic studies carried out, as described above, in tumor-bearing mice using the constructs AK032, AK081, AK111, AK167, and AK168, as well as an anti-RSV control. FIG. 23A provides a simplistic depiction of the structure of each of the constructs tested. As indicated, AK111 and AK168 are exemplary masked IL-2 polypeptide constructs. The AK167 and AK168 constructs include mutations (R38A, F42A, Y45A, and E62A) that eliminate or reduce binding to CD25. FIG. 23B shows Fc levels in plasma (μg/mL) by detecting human IgG, FIG. 23C shows Fc-CD122 levels in plasma (μg/mL) by detecting human CD122, and FIG. 23D shows Fc-IL2 levels in plasma (μg/mL) by detecting human IL-2.

Figure 24C:
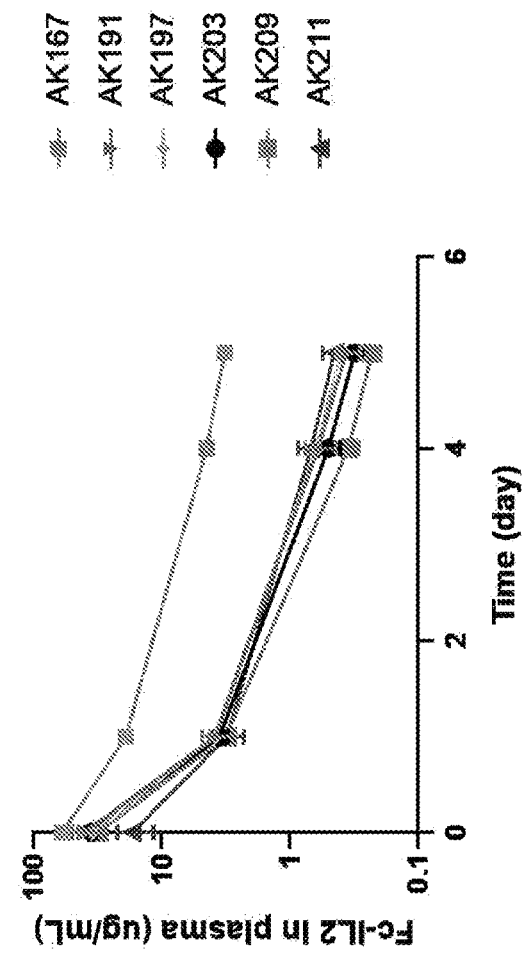
Figure 24D:
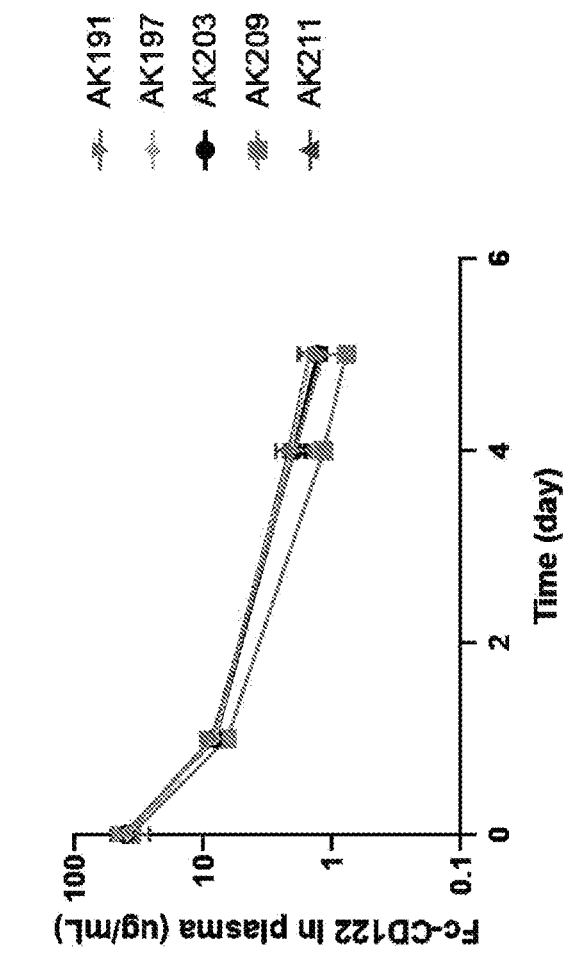
Figure 25B:
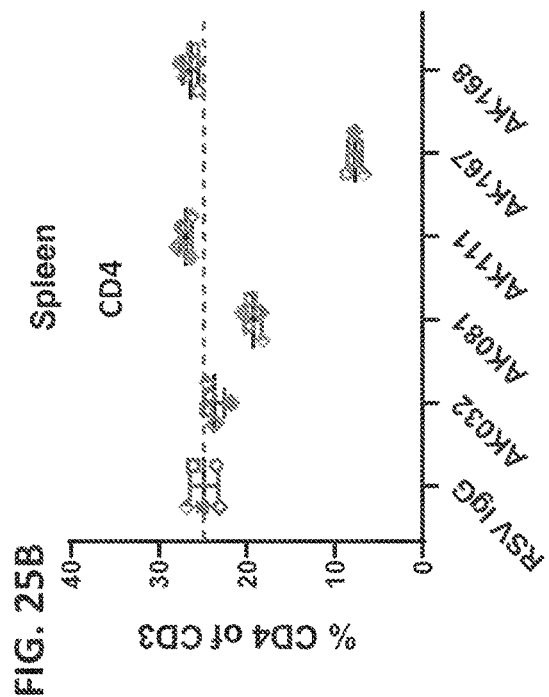
FIGS. 25A-25L shows results from studies testing the in vivo responses of CD4, CD8, NK, and Treg percentages in spleen, blood, and tumor, using the AK032, AK081, AK111, AK167, or AK168 construct, or an anti-RSV IgG control. For spleen tissue, % CD8 cells of CD3 cells (FIG. 25A), % CD4 of CD3 cells (FIG. 25B), % NK cells of CD3– cells (FIG. 25C), % FoxP3 of CD4 cells (FIG. 25D) is shown. For blood, % CD8 cells of CD3 cells (FIG. 25E), % CD4 of CD3 cells (FIG. 25F), % NK cells of CD3– cells (FIG. 25G), % FoxP3 of CD4 cells (FIG. 25H) is shown. For tumor tissue, % CD8 cells of CD3 cells (FIG. 25I), % CD4 of CD3 cells (FIG. 25J), % NK cells of CD3– cells (FIG. 25K), % FoxP3 of CD4 cells (FIG. 25L) is shown.
Figure 25D:
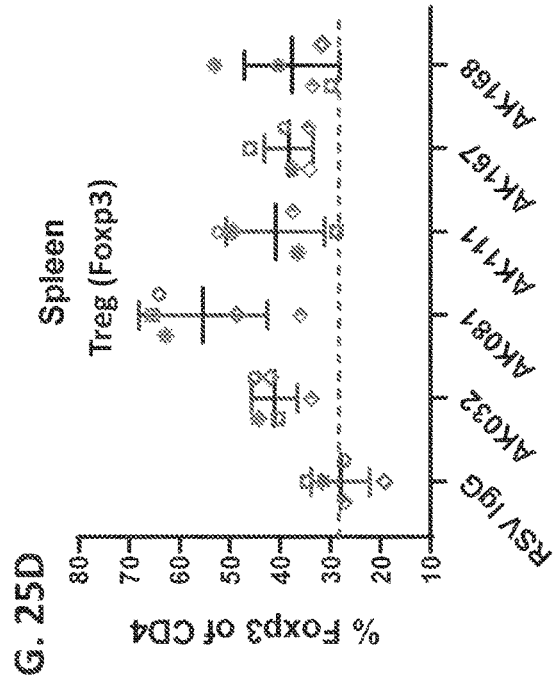
Figure 25A:
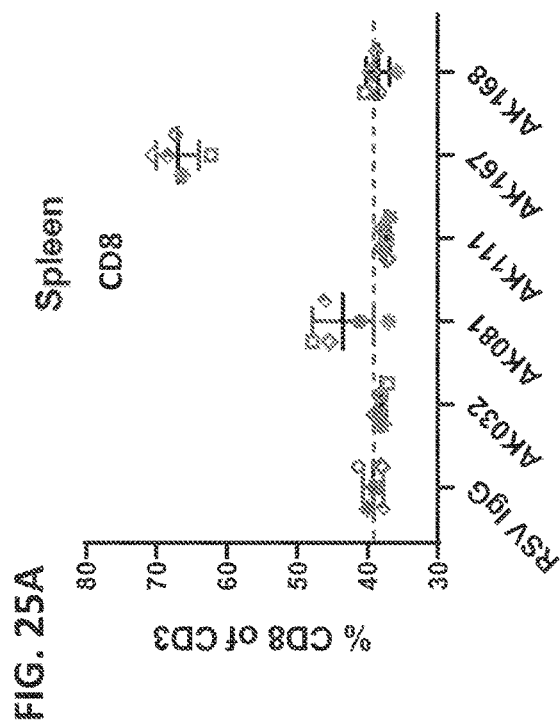
Figure 25C:
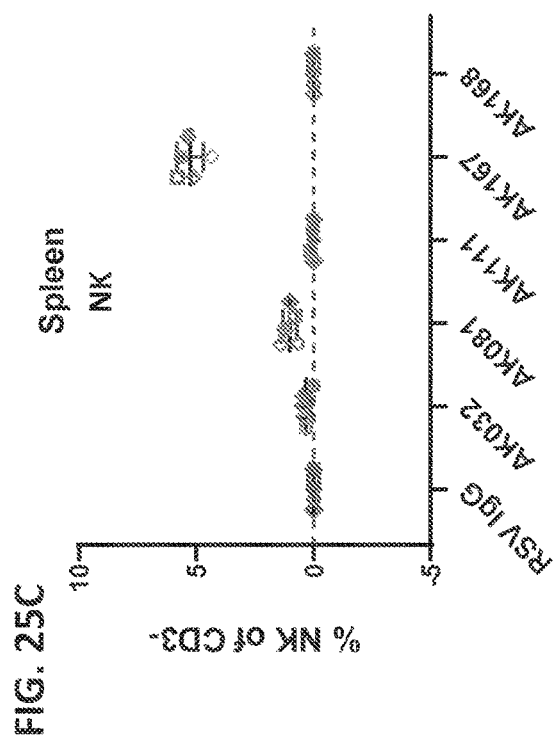
Figure 25F:
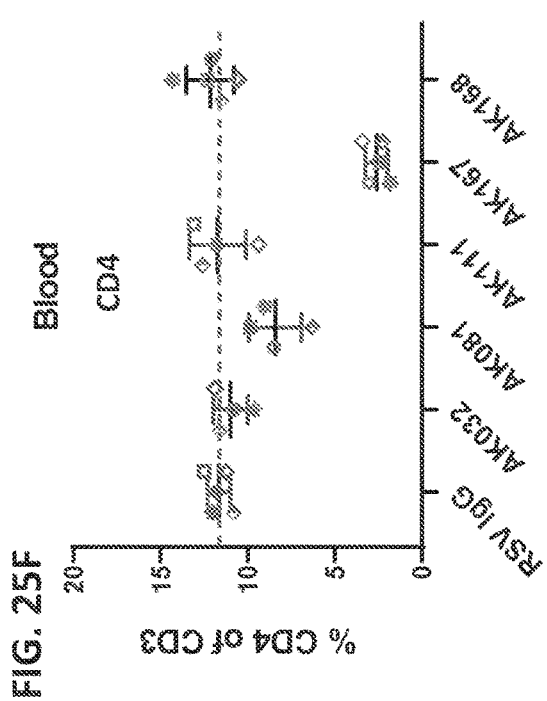
Figure 25H:
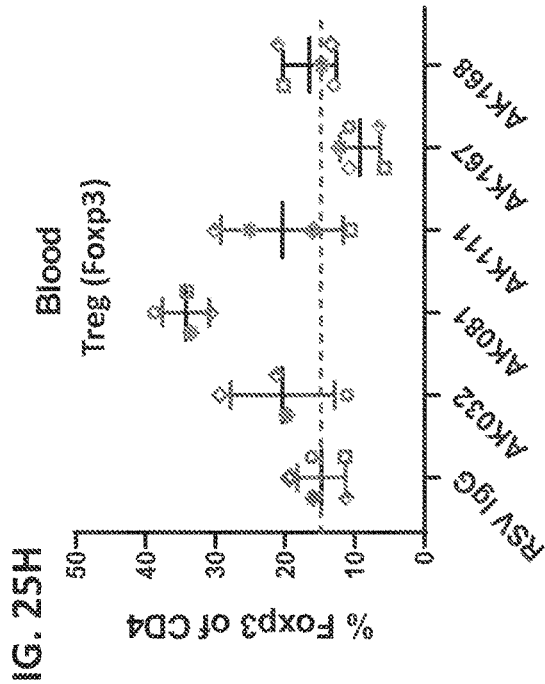
Figure 25E:
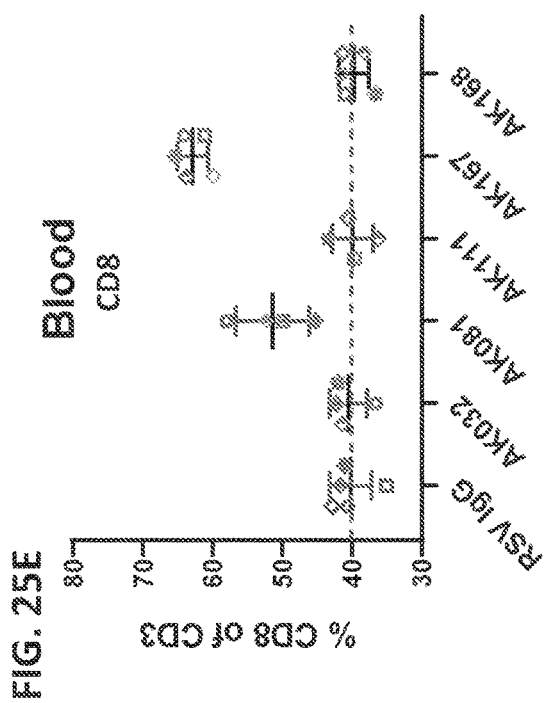
Figure 25G:
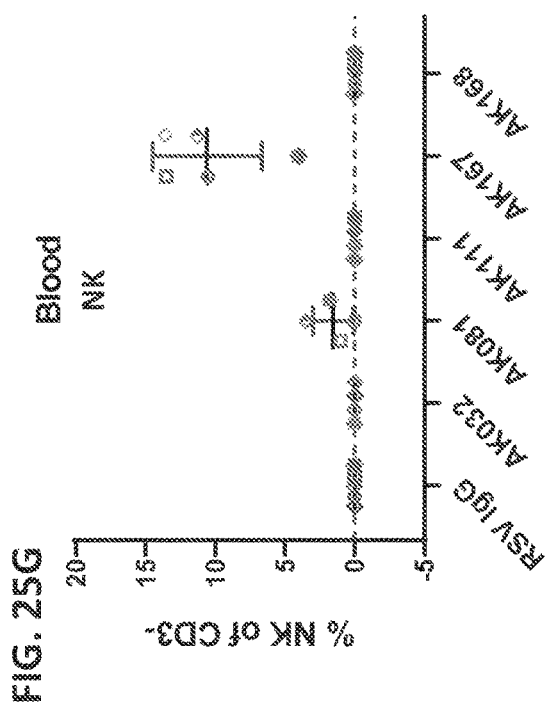
Figure 25J:
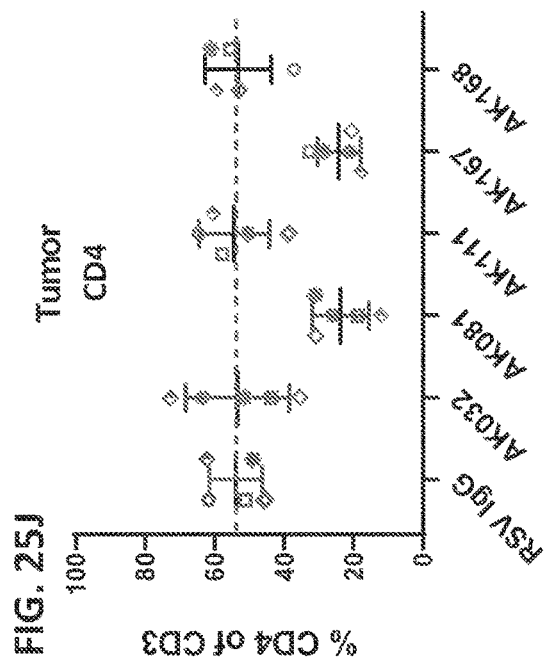
Figure 25L:
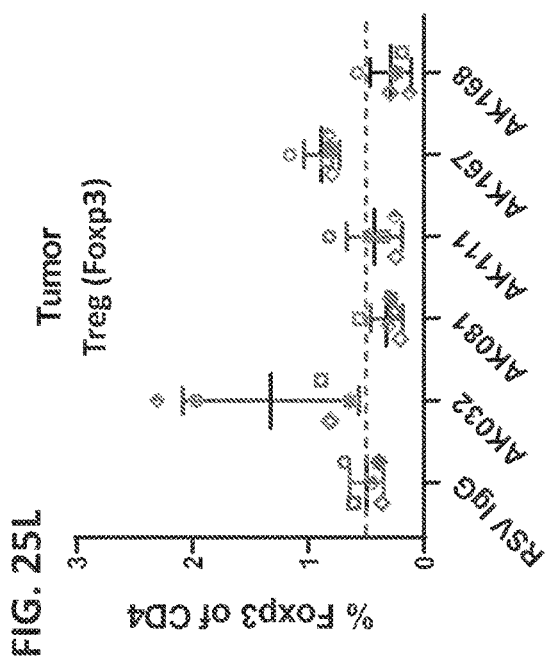
Figure 25I:
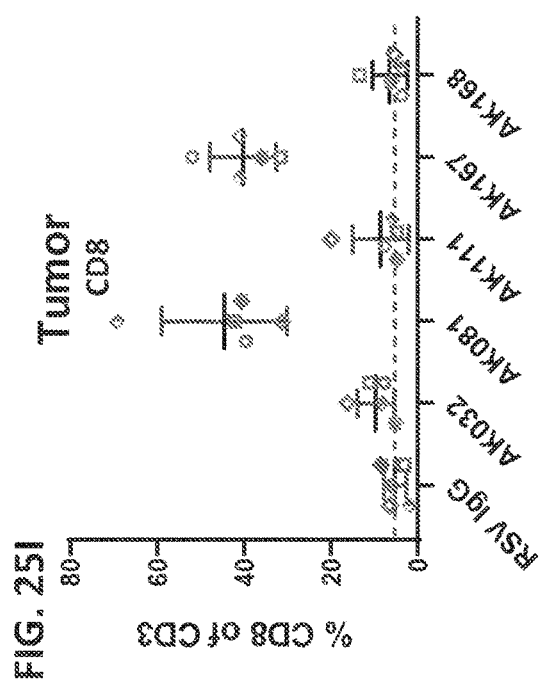
Figure 25K:
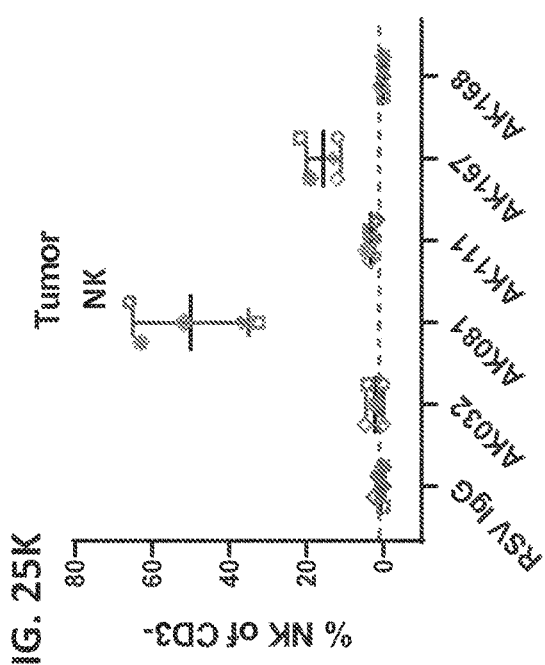
Figure 26F:
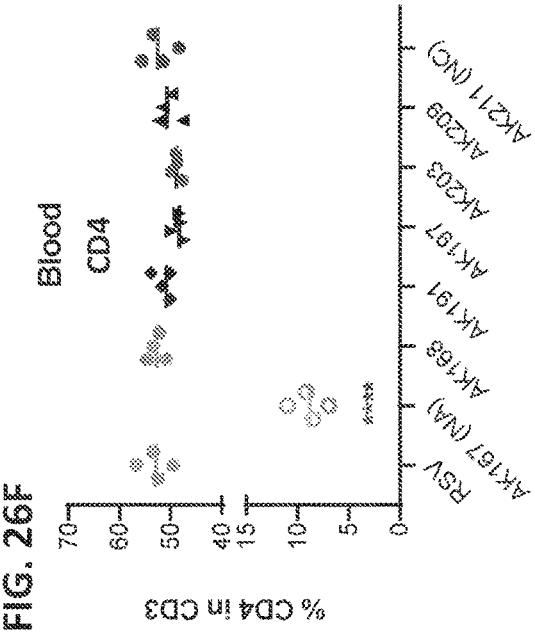
Figure 26H:
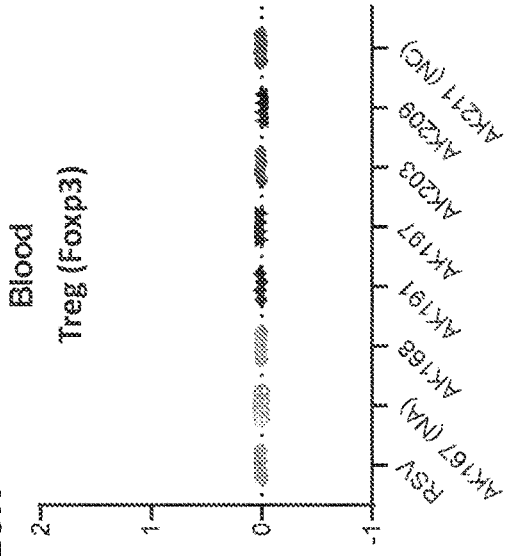
Figure 26E:
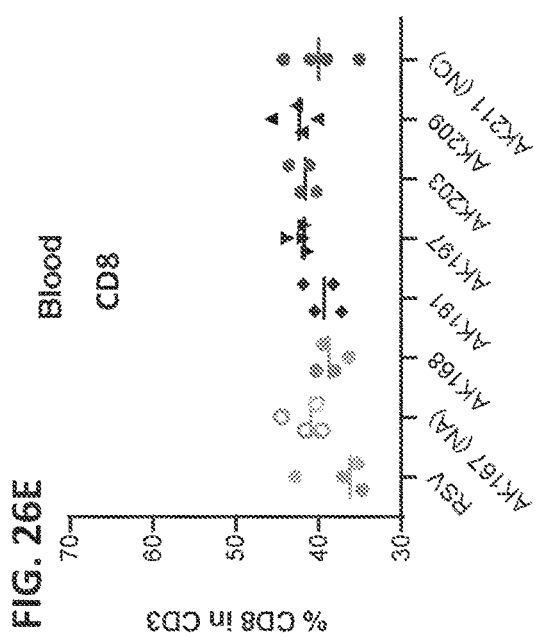
Figure 26G:
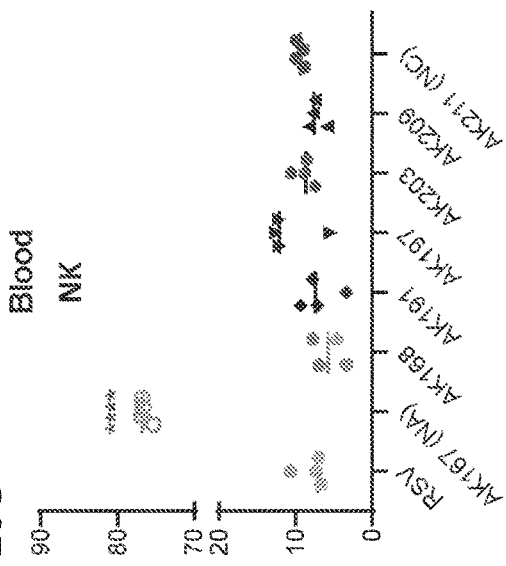
Figure 27B:
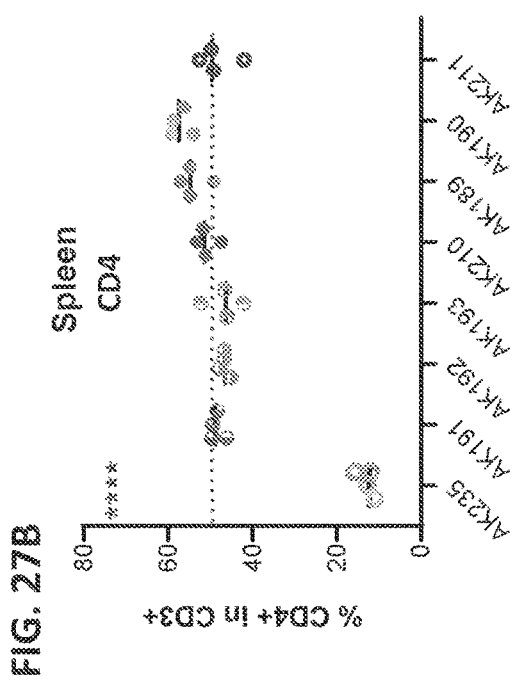
FIGS. 27A-27L shows results from studies testing the in vivo responses of CD4, CD8, NK, and Treg percentages in spleen, blood, and tumor, using the AK235, AK191, AK192, AK193, AK210, AK189, AK190, or AK211 construct, or an anti-RSV IgG control. For spleen tissue, % CD8 cells of CD3 cells (FIG. 27A), % CD4 of CD3 cells (FIG. 27B), % NK cells of CD3– cells (FIG. 27C), % FoxP3 of CD4 cells (FIG. 27D) is shown. For blood, % CD8 cells of CD3 cells (FIG. 27E), % CD4 of CD3 cells (FIG. 27F), % NK cells of CD3– cells (FIG. 27G), % FoxP3 of CD4 cells (FIG. 27H) is shown. For tumor tissue, % CD8 cells of CD3 cells (FIG. 27I), % CD4 of CD3 cells (FIG. 27J), % NK cells of CD3– cells (FIG. 27K), % FoxP3 of CD4 cells (FIG. 27L) is shown.
Figure 27D:
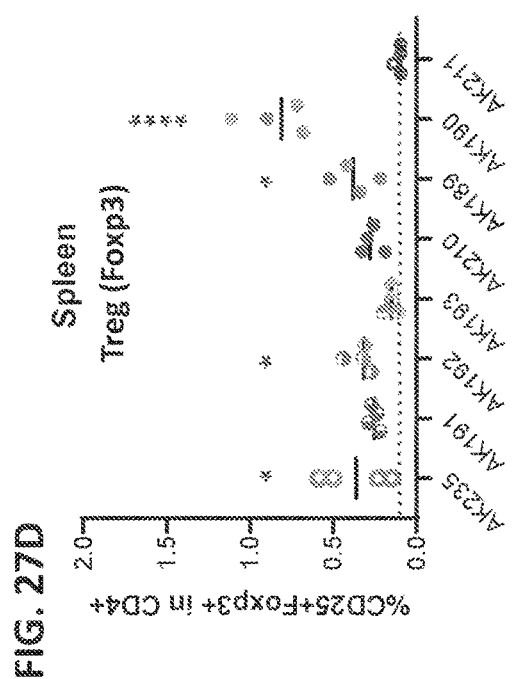
Figure 27A:
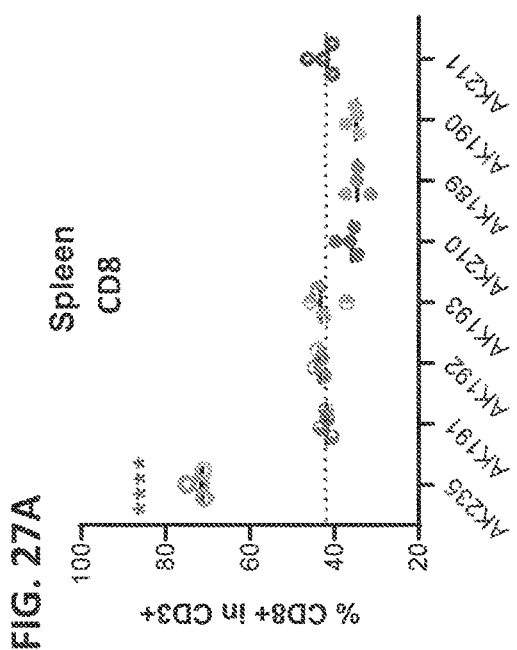
Figure 27C:
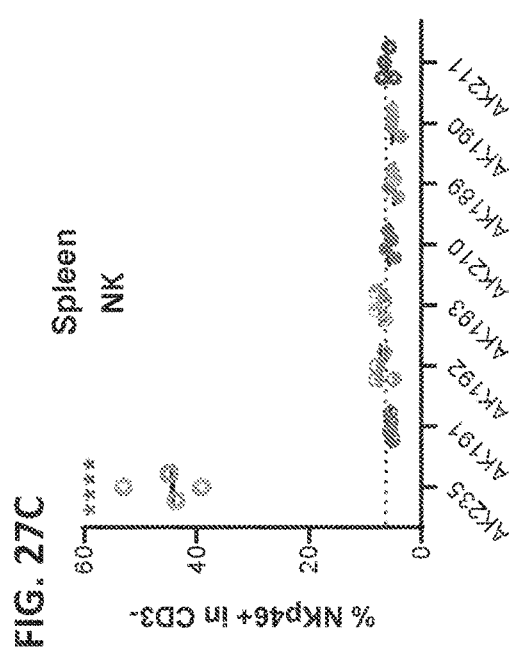
Figure 27F:
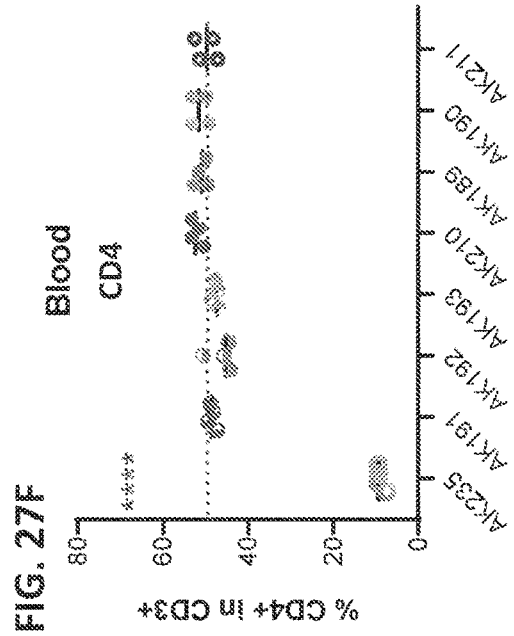
Figure 27H:
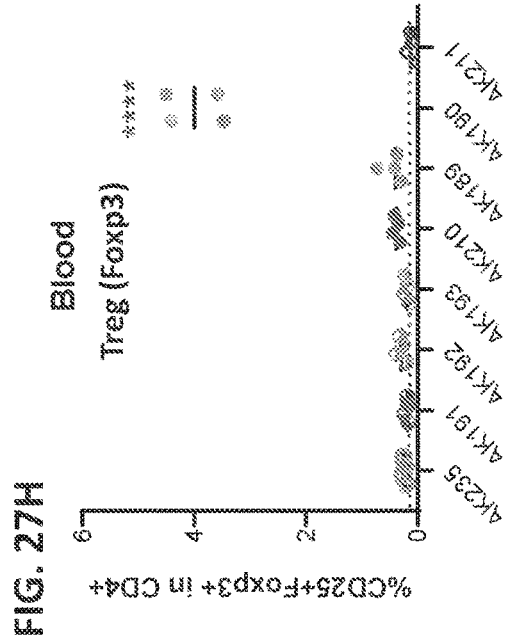
Figure 27E:
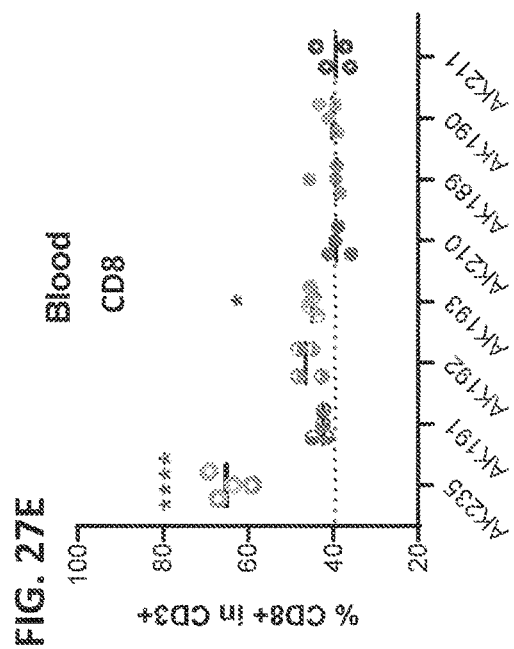
Figure 27G:
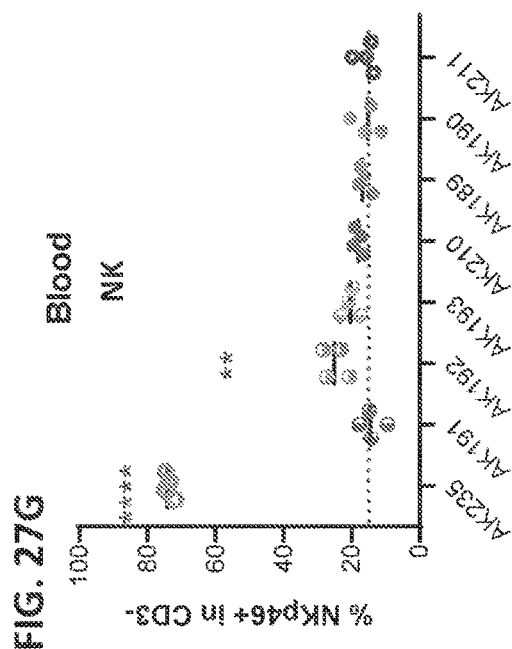
Figure 27J:
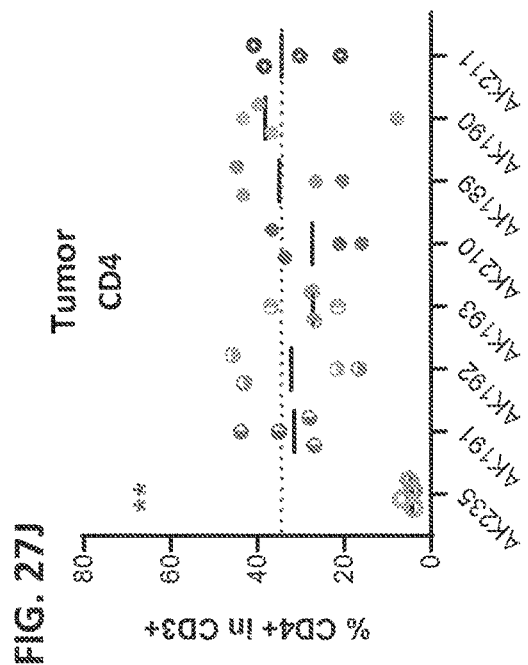
Figure 27L:
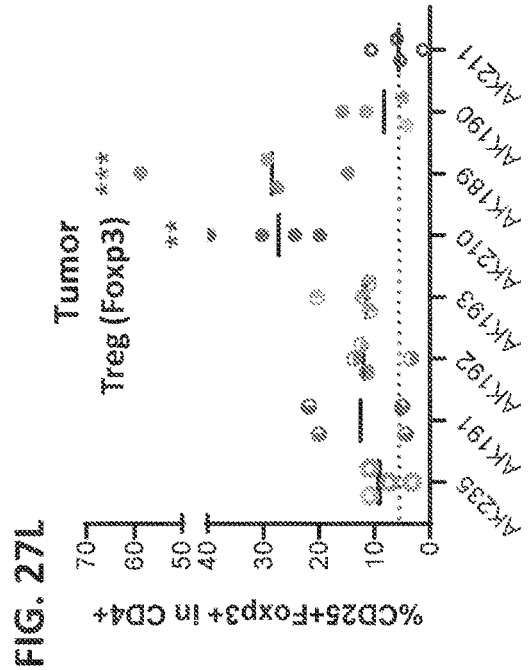
Figure 27I:
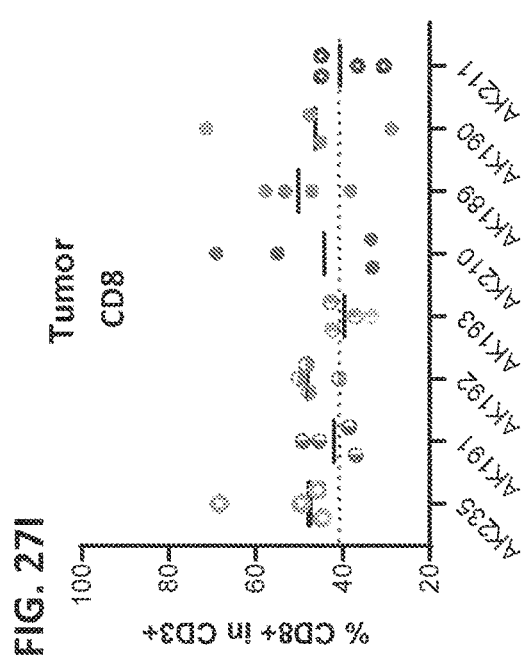
Figure 27K:
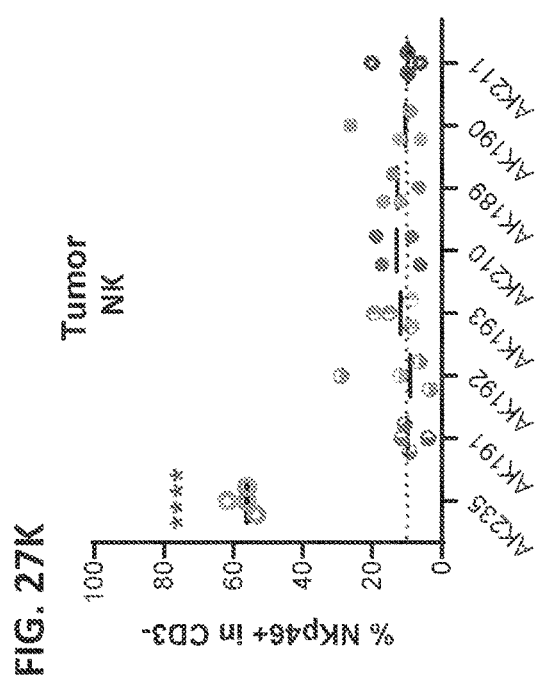
Figure 28E:
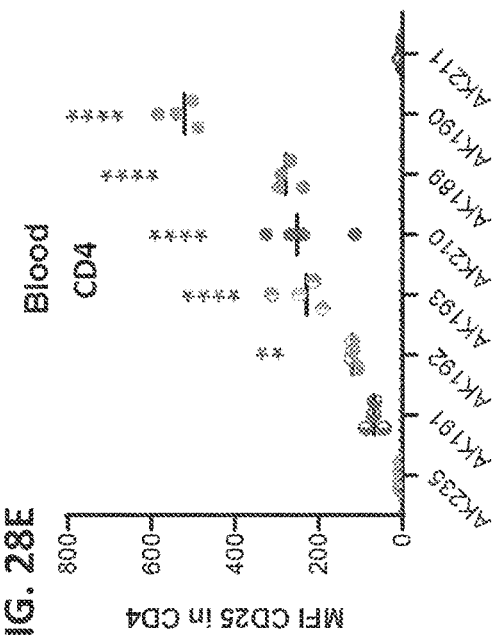
Figure 28D:
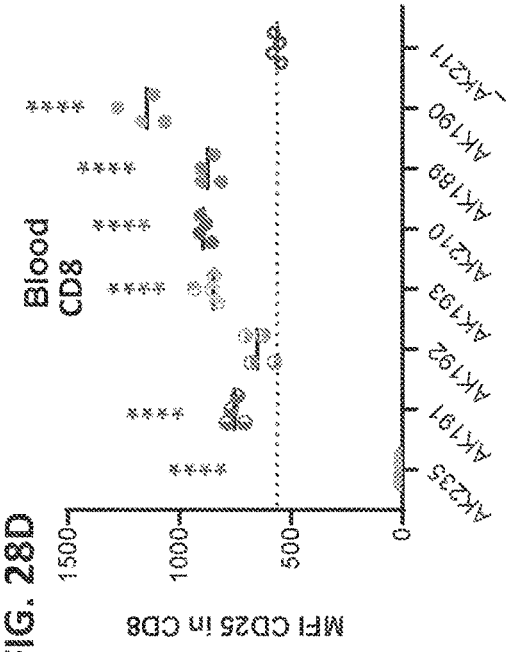
Figure 28F:
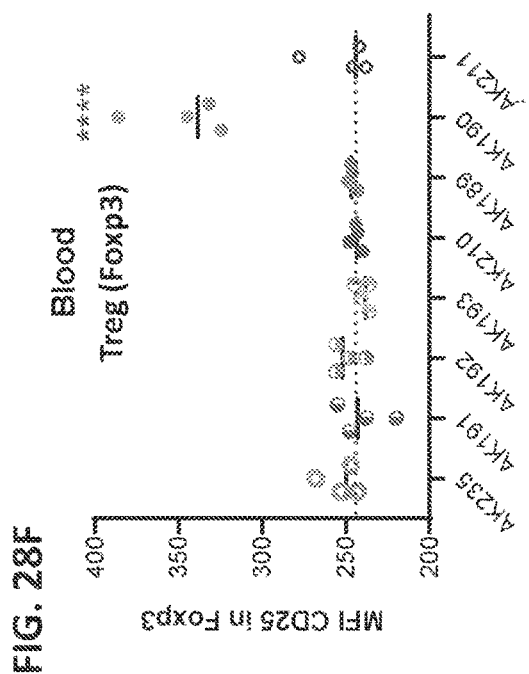
Figures 28G, 28H, 28I:
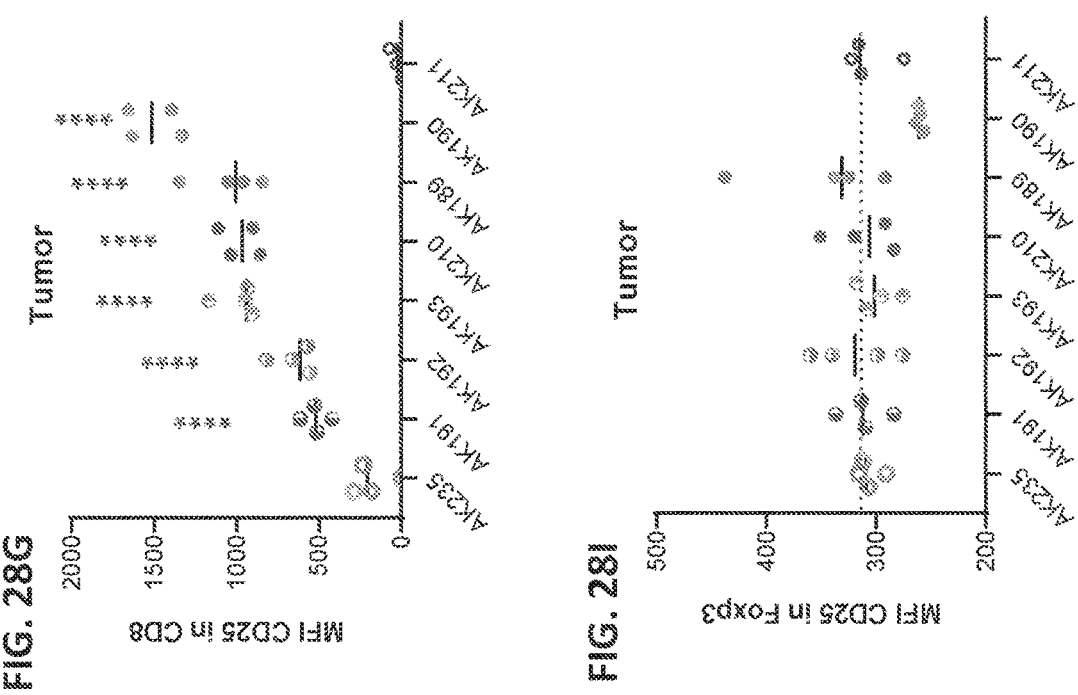

FIGS. 24A-24D describe results from pharmacokinetic studies carried out, as described above, in tumor-bearing mice using the constructs AK167, AK191 AK197, AK203, AK209, and AK211, as well as an anti-RSV control. FIG. 24A provides a simplistic depiction of the structure of each of the constructs tested. As indicated, AK168, AK191, AK197, AK203, and AK209 are exemplary masked IL-2 polypeptide constructs that each include a different cleavable peptide sequence in the linker connecting the IL-2 polypeptide to the half-life extension domain. FIG. 24B shows Fc levels in plasma (μg/mL) by detecting human IgG, FIG. 24C shows Fc-IL2 levels in plasma (μg/mL) by detecting human IL-2, and FIG. 24D shows Fc-CD122 levels in plasma (μg/mL) by detecting human CD122. As shown in FIGS. 24B, 24C, and 24D, the Fc levels, Fc-IL2 levels, and Fc-CD122 levels in the plasma are similar among the masked IL-2 polypeptide constructs tested.

Bioactivity in Mice

The in vivo bioactivity of the masked IL-2 polypeptide constructs and the masked IL-15 polypeptide constructs generated in Example 1 is assessed in vivo using mouse models, such as C57BL/6 mice. Mice are treated with the constructs and in vivo bioactivity is assessed. In some experiments, some mice are treated with controls for comparison. In some experiments, some mice are treated with aldesleukin as a control for masked IL-2 polypeptide treatment. In some experiments, the mice that are treated have tumors. In some experiments, the mice that are treated are tumor-free. In some experiments, the dose-dependent expansion of immune cells is assessed in the mice. In some experiments, the mice are treated with various doses of a construct, aldesleukin, or other control. In some experiments, the mice are treated over the course of two weeks. Blood is collected from the mice at various time points and is then stained using antibodies to immune cell markers of interest. In some experiments, the longitudinal kinetics of the proliferation and expansion of certain circulating cell types, such as CD8+ T cells, NK cells, and Treg cells, is also determined, as well as the ratio of CD8+ T cells and NK cells to CD4+ CD25+ FoxP3+ Treg cells. In some experiments, the mice are assessed for vascular leakage, such as by assessing for edema and lymphocyte infiltration in certain organs like the lung and liver as determined by organ wet weight and histology.

In some studies, vascular leakage was assessed in order to assess potential toxicity-related effects mediated by IL-2 based therapies by performing the following method. Repeated dose toxicity studies were conducted using C57BL/6 female mice that were purchased from Charles River Laboratories and were 8-10 weeks old weighing 18-22 grams at the start of study. Groups of 5 mice received daily intraperitoneal injections of masked and non-masked IL-2 constructs in PBS daily for 4 or 5 days. The constructs tested included AK081, AK111, AK167, and AK168. A control antibody was also administered as a control. Two hours after the last dose, all mice received an intravenous injection of 0.1 ml of 1% Evans blue (Sigma, cat #E2129) in PBS. Two hours after Evans blue administration, mice were anesthetized and perfused with 10 U/ml heparin in PBS. Spleen, lung and liver were harvested and fixed in 3 ml of 4% PFA 2 days at 4° C. prior to measuring the absorbance of the supernatant at 650 nm with NanoDrop OneC (Thermo Fisher Scientific, Waltham, Mass.) as an indicator of vascular leak of Evans blue. Fixed organs were embedded in paraffin, sectioned, and stained with hematoxylin and eosin. Histopathological studies and quantification were carried out by NovoVita Histopath Laboratory, LLC. (Allston, Mass.) according to standard procedures. FIGS. 30A-30D depict results from an in vivo study as described above for assessing vascular leakage using the exemplary masked IL-2 polypeptide constructs AK111 and AK168, as well as the non-masked IL-2 polypeptide constructs AK081 and AK167, and an anti-RSV control. FIG. 30A shows the percentage (%) of body weight loss, and FIGS. 30B, 30C, and 30D shows the weight in grams of the liver, lung, and spleen, respectively, for each.

Figure 31A:
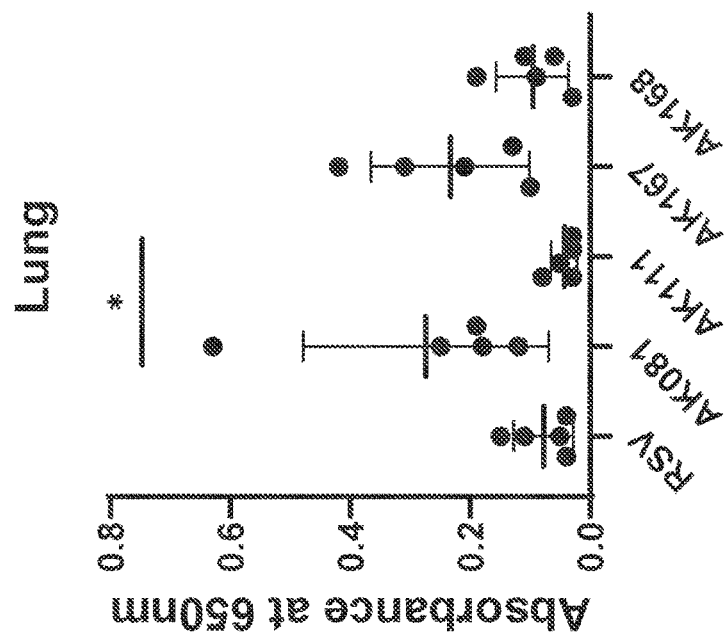
FIGS. 31A and 31B shows results from an in vivo study that assessed vascular leakage as indicated by measuring the extent of dye leakage into liver and lung tissue following administration of the AK081, AK111, AK167, or AK168 construct, or an anti-RSV control. The extent of dye leakage into liver (FIG. 31A) and lung (FIG. 31B) was measured based on absorbance at 650 nm.
Figure 31B:
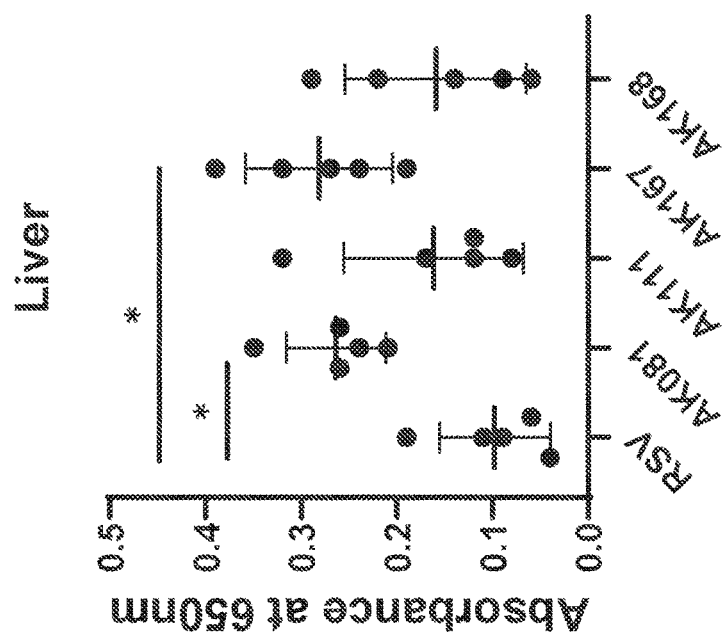

Vascular leakage as indicated by measuring the extent of dye leakage into tissues was also assessed for the AK081, AK111, AK167, and AK168 constructs, along with an anti-RSV control, with results shown in FIGS. 31A and 31B for the liver and lung, respectively. The extent of dye leakage was measured based on absorbance at 650 nm.

Figure 32A:
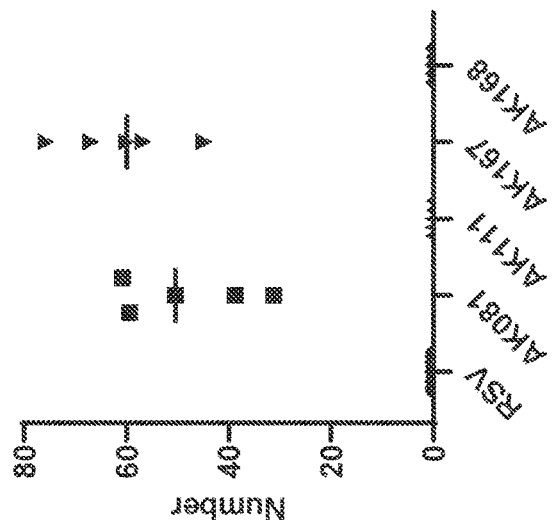
FIGS. 32A and 32B shows results from an in vivo study that assessed vascular leakage as indicated by measuring the extent of mononuclear cell perivascular invasion into into the liver and lung tissue following administration of the AK081, AK111, AK167, or AK168 construct, or an anti-RSV control. The average number of mononuclear cells in the liver (FIG. 32A) and the average number of mononuclear cells in the lung (FIG. 32B) depicted for each.
Figure 32B:
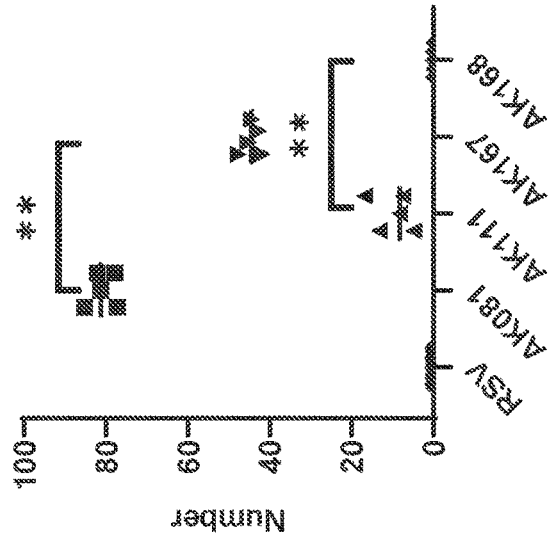

Vascular leakage as indicated by measuring the extent of mononuclear cell perivascular invasion into the liver and lung was also assessed for the AK081, AK111, AK167, and AK168 constructs, along with an anti-RSV control, with results shown in FIGS. 32A and 32B for the liver and lung, respectively. The average number of mononuclear cells in the liver (FIG. 32A) and the average number of mononuclear cells in the lung (FIG. 32B) depicted for each. As shown in FIG. 32B, for instance, the masked IL-2 polypeptide constructs AK111 and AK168 did not result in a detectable number of mononuclear cells in the lung, unlike the non-masked constructs AK081 and AK167.

Infiltrating Immune Cell Phenotype

The phenotype of immune cells infiltrating tumors in vivo in mouse models treated with the masked IL-2 polypeptide constructs or the masked IL-15 polypeptide constructs generated in Example 1 is assessed. Mice are treated with the constructs and the phenotype of tumor-infiltrating immune cells is assessed. In some experiments, some mice are treated with controls for comparison. In some experiments, some mice are treated with aldesleukin as a control for masked IL-2 polypeptide treatment. Mice bearing tumors are treated with a construct, aldesleukin, or another control, and tumors, tissues such as liver, lung, and spleen, and blood, are collected at various time points following the initial dose, such as five days, seven days, or ten days after the initial dose. In some experiments, immune cells are isolated from the tumors, tissues, and blood, and are subject to phenotypic assessment using flow cytometry. In some experiments, the isolated immune cells are assessed using markers of interest, such as those for CD8+ T cells, Memory CD8+ T cells, activated NK cells, CD4+ T cells, and CD4+ Treg cells.

In some studies, the phenotype of immune cells infiltrating tumors in vivo was assessed using the following method. C57BL/6 female mice were purchased from Charles River Laboratories and were 8-10 weeks old at the start of study. MC38 tumor cells ($5 \times 10^5$ cells per mouse) were injected subcutaneously into the right flank of each mouse. Upon reaching ~100 mm$^3$ sized tumors (day 0), the mice received a single 2 mg/kg intravenous dose of the construct of interest (e.g., a non-masked parental IL-2 polypeptide construct, a masked IL-2 polypeptide construct, or a non-cleavable masked IL-2 polypeptide construct) in PBS. On day 5, mice were euthanized by CO2 asphyxiation and tumors, livers, spleens and blood were harvested. Cell suspensions were prepared from spleens by mechanical disruption and and passing through a 40 µm cell strainer. The tumor tissues were enzymatically digested using Miltenyi Tumor Dissociation Kit reagents (Miltenyi cat #130-096-730) and the gentleMACS Dissociator (Miltenyi) was used for the mechanical dissociation steps. Red blood cells in the spleen and tumor cell suspensions and blood were lysed using ACK buffer (Gibco cat #A10492). The cell suspensions were stained with the following antibodies: CD45 (clone 30-F11, eBioscience), CD3 (clone 2C11, Biolegend), CD8 (clone 53-6.7, BD Biosciences), CD4 (clone RM-45, BD Biosciences), FOXP3 (MF-14, Biolegend), CD25 (3C7, Biolegend), CD44 (clone IM7, eBioscience), and NKp46 (29A1.4, eBioscience). Data acquisition was carried out on the MACSQuant Analyzer flow cytometer (Milenyi) and data were analyzed using the FlowJo.

Results from studies testing the in vivo responses of CD4, CD8, NK, and Treg percentages in spleen, blood, and tumor, as carried out as described above, using the AK032, AK081, AK111, AK167, and AK168 constructs, as well as an anti-RSV IgG control, are shown in FIGS. 25A-25L. AK111 and AK168 are exemplary masked IL-2 polypeptide constructs.

Results from studies testing the in vivo responses of CD4, CD8, NK, and Treg percentages in spleen, blood, and tumor, as carried out as described above, using the AK167, AK168, AK191, AK197, AK203, AK209, and AK211 constructs, as well as an anti-RSV IgG control, are shown in FIGS. 26A-26L. AK168, AK191, AK197, AK203, and AK209 are exemplary masked IL-2 polypeptide constructs that each include a different cleavable peptide sequence in the linker connecting the IL-2 polypeptide to the half-life extension domain. Statistical analysis was performed using One-way ANOVA as compared to the non-cleavable AK211 construct.

Results from studies testing the in vivo responses of CD4, CD8, NK, and Treg percentages in spleen, blood, and tumor, as carried out as described above, using the AK235, AK191, AK192, AK193, AK210, AK189, AK190, and AK211 constructs are shown in FIGS. 27A-27L. AK191, AK192, AK193, AK210, AK189, and AK190 are exemplary masked IL-2 polypeptide constructs that each include a cleavable peptide sequence in the linker connecting the IL-2 polypeptide to the half-life extension domain. The linker sequence also differs among these constructs, depending on the linker sequence utilized. AK189, AK190, and AK210 include an IL-2 polypeptide having a C125A mutation, and AK191, AK192, and AK193 include an IL-2 polypeptide having C125A, R38A, F42A, Y45A, and E62A mutations. The AK235 construct is a non-masked construct and the AK211 construct includes a non-cleavable linker sequence. Statistical analysis was performed using One-way ANOVA as compared to the non-cleavable AK211 construct.

Results from studies testing the in vivo T cell activation in spleen, blood, and tumor, as carried out as described above, using the AK235, AK191, AK192, AK193, AK210, AK189, AK190, and AK211 constructs, as described above, are shown in FIGS. 28A-28I. T cell activation was measured as the mean fluorescence intensity (MFI) of CD25 in CD8+ T cells, CD4+ T cells, or Foxp3+ cells in the spleen, blood, and tumor. Statistical analysis was performed using One-way ANOVA as compared to the non-cleavable AK211 construct.

In Vivo Cleavage

The in vivo cleavage of masked cytokine constructs (e.g., masked IL-2 polypeptide constructs or masked IL-15 polypeptide constructs) is assessed. In some studies, a control antibody is administered for comparison. In some studies, in vivo cleavage is assessed by administering the construct of interest in a mouse and, after a certain period of time, capturing human IgG and then measuring the levels of, e.g., human IgG, CD122, and IL-2 or IL-15.

Figure 29A:
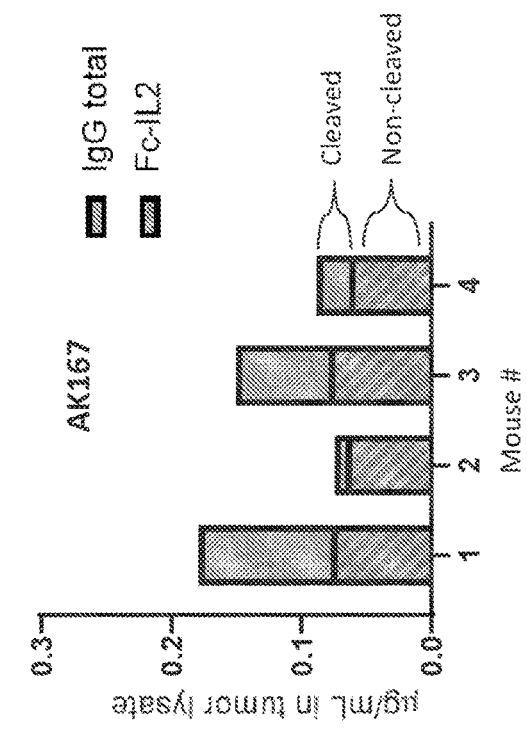
FIGS. 29A-29D show the results from studies testing the in vivo cleavage of the exemplary masked IL-2 polypeptide constructs AK168 (cleavable peptide sequence: MPYD-LYHP; SEQ ID NO: 96) and AK209 (cleavable peptide sequence: VPLSLY; SEQ ID NO: 135).
Figure 29B:
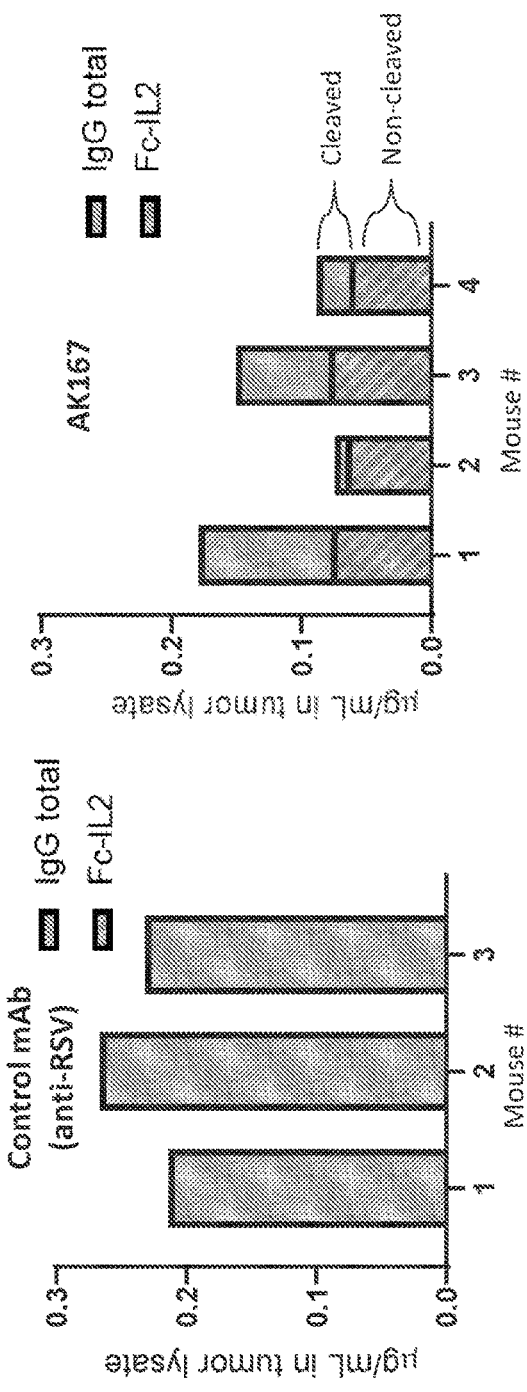
Figure 29C:
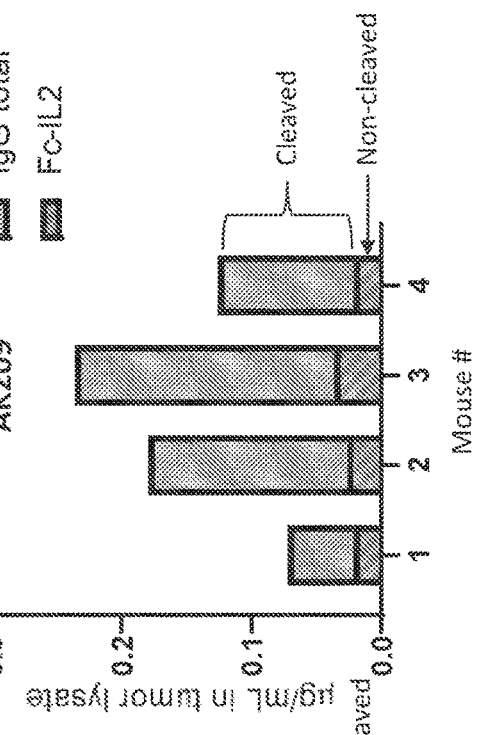
Figure 29D:
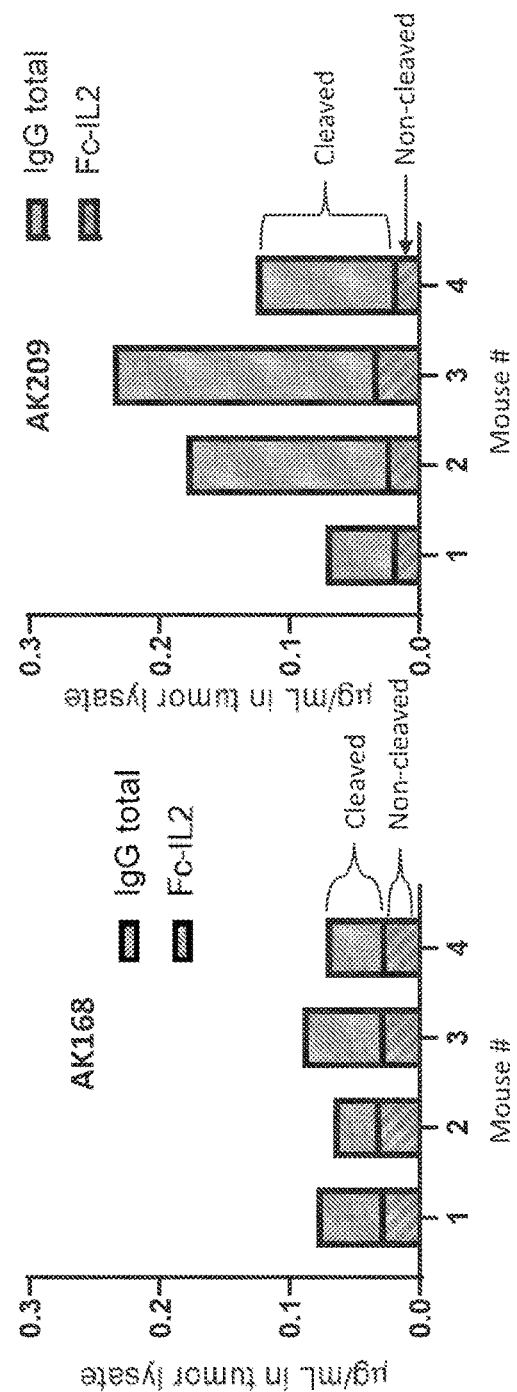
Figure 29E:
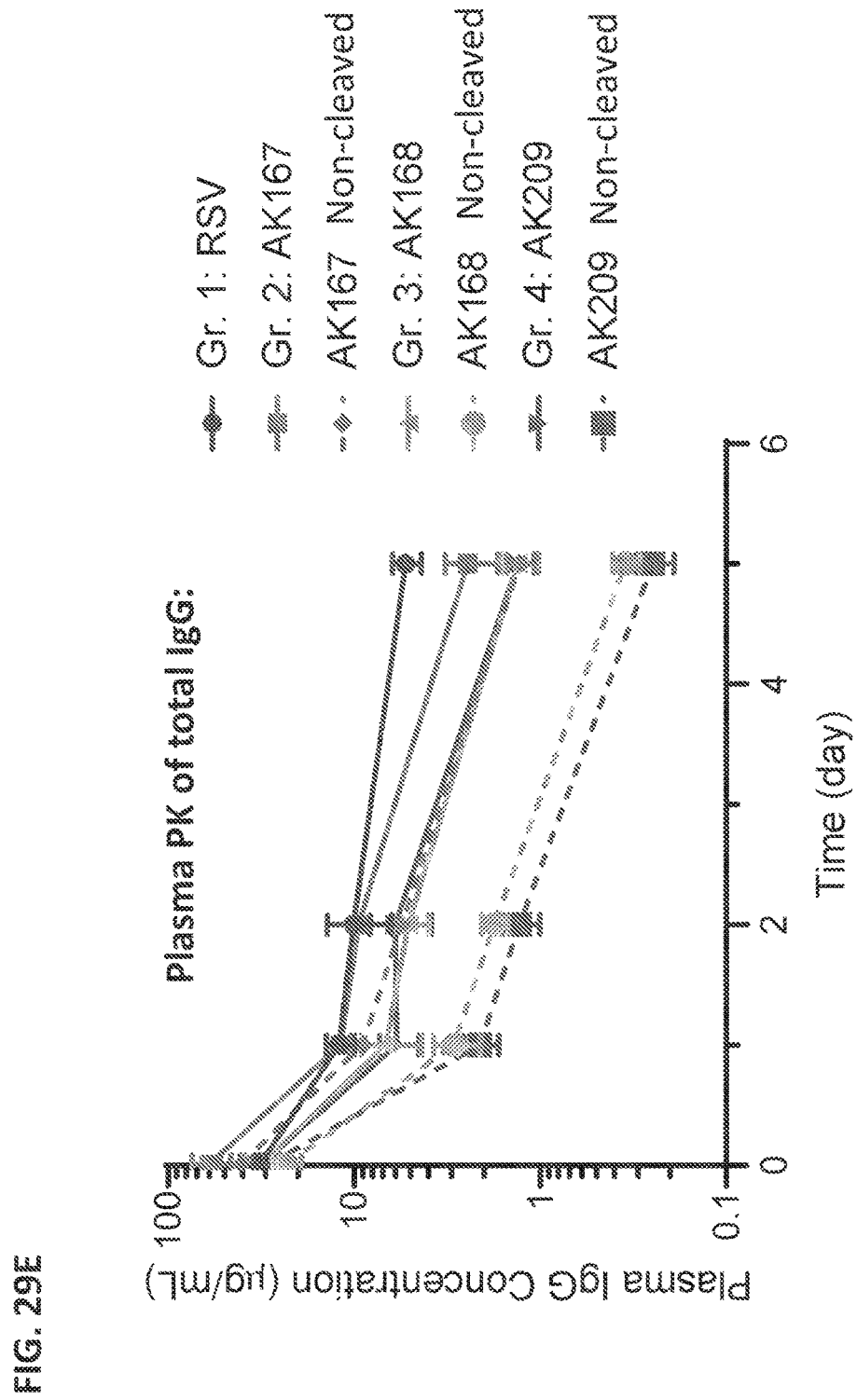
FIG. 29E shows results from a pharmacokinetic study of total plasma IgG concentration (μg/mL) for total levels of the AK167, AK168, and AK209 constructs, and for levels of non-cleaved forms of each construct.

In some studies testing the in vivo cleavage of masked IL-2 polypeptide constructs, drug levels (i.e., levels of the administered construct, including cleavage byproducts) were determined using ELISAs utilizing anti-human IgG (clone M1310G05, Biolegend) as the capture antibody and various detection antibodies. HRP or biotin conjugated detection antibodies against human IgG (ab97225, Abcam) or CD122 (clone 9A2, Ancell) and IL-2 (Poly5176, Biolegend) were utilized to detect total and non-cleaved drug levels, respectively. The concentrations of cleaved and released IL-2 is calculated by subtracting non-cleaved (i.e., intact) from total drug concentrations. FIGS. 29A-29D depict the results from studies testing the in vivo cleavage of the exemplary masked IL-2 polypeptide constructs AK168 (cleavable peptide sequence: MPYDLYHP; SEQ ID NO: 96) and AK209 (cleavable peptide sequence: VPLSLY; SEQ ID NO: 135). The AK167 construct is a cleavable non-masked IL-2 polypeptide construct that includes the same IL-2 polypeptide as the masked AK168 construct. As shown in FIGS. 29B-29D, both the masked (AK168 and AK209) and non-masked (AK167) constructs were effectively cleaved, and both cleavable peptide sequences were cleaved. FIG. 29E depicts results from a pharmacokinetic study of total plasma IgG concentration (µg/mL) for total levels of the AK167, AK168, and AK209 constructs, and for levels of non-cleaved forms of each construct.

Tumor Eradication and Inhibition of Metastasis

The ability of the masked IL-2 polypeptide constructs and the masked IL-15 polypeptide constructs generated in Example 1 to promote tumor eradication and to inhibit metastasis is assessed in vivo using mouse models, such as syngeneic MC38, CT26, and B16F10 tumor models.

Mice are implanted with tumor cells subcutaneously, and tumors are allowed to grow to a palpable size. Tumor-bearing mice are treated with the masked IL-2 constructs or the masked IL-15 polypeptide constructs and tumor volume is measured over the course of treatment. In some experiments, some mice are treated with controls for comparison. In some experiments, some mice are treated with aldesleukin as a control for masked IL-2 polypeptide treatment. Tumor volume is measured periodically over the course of treatment. In some experiments, body weight is also measured periodically over the course of treatment. In some experiments, plasma samples are produced over the course of the treatment and analyzed for pharmacokinetics, pharmacodynamics, cleavage, and blood markers, such as those for CD8+ T cells, Memory CD8+ T cells, activated NK cells, CD4+ T cells, and CD4+ Treg cells.

The capability of the masked IL-2 polypeptide constructs and the masked IL-15 polypeptide constructs to inhibit metastasis is also assessed in vivo using mouse models suitable for metastasis studies, such as syngeneic CT26 tumor models for assessing lung metastasis. Mice are implanted with tumor cells subcutaneously. In some experiments, tumors are allowed to grow to a palpable size prior to treatment. In some experiments, treatment begins before tumors grow to palpable size. Tumor-bearing mice are treated with the masked IL-2 constructs or the masked IL-15 polypeptide constructs and are assessed for tumor cell metastasis into tissues such as lungs, liver, and lymph nodes.

Figure 33A:
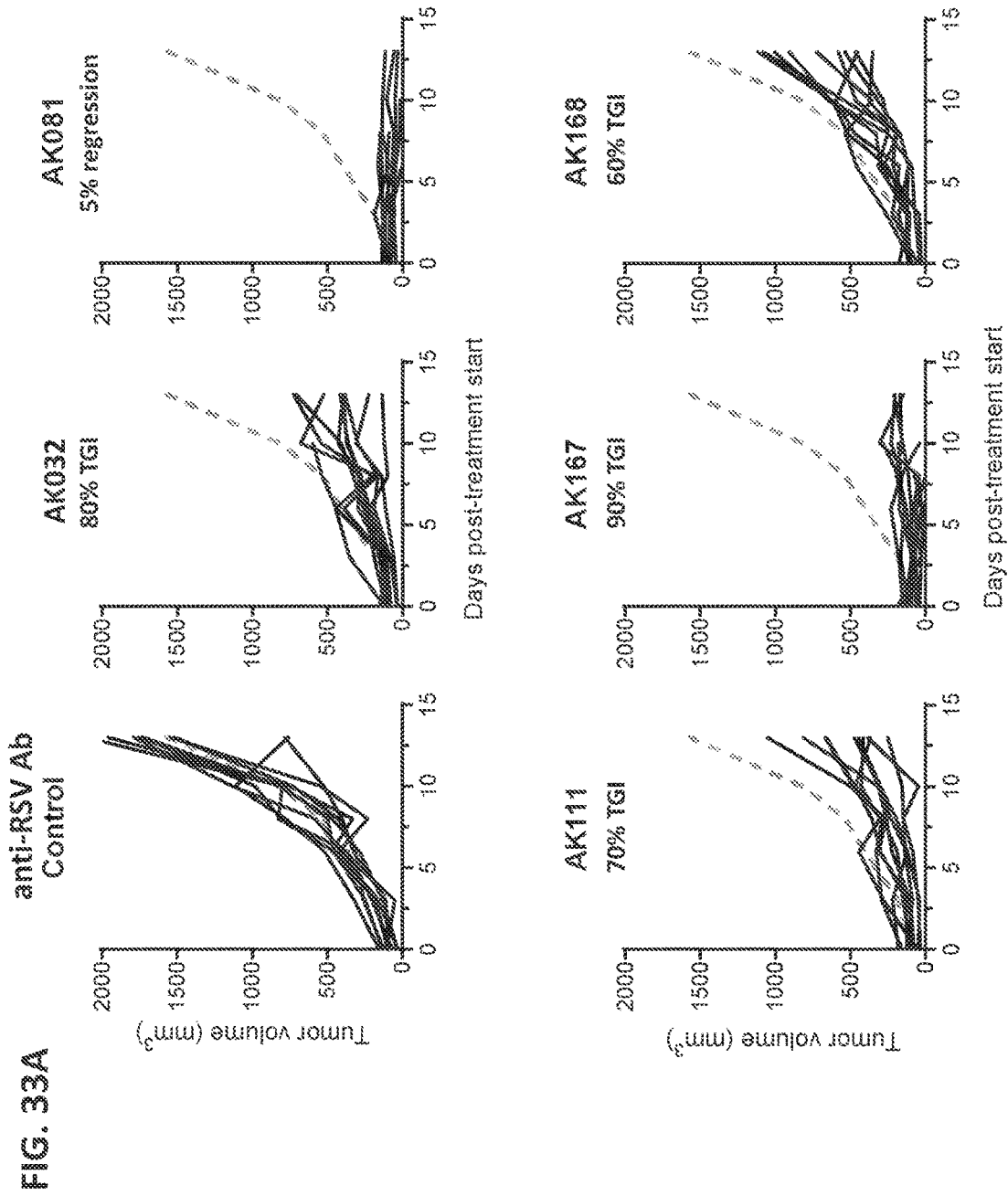
FIGS. 33A and 33B show results from a syngeneic tumor model study that assessed tumor volume and body weight over the course of treatment with the AK032, AK081, AK111, AK167, or AK168 construct, or an anti-RSV control.
Figure 33B:
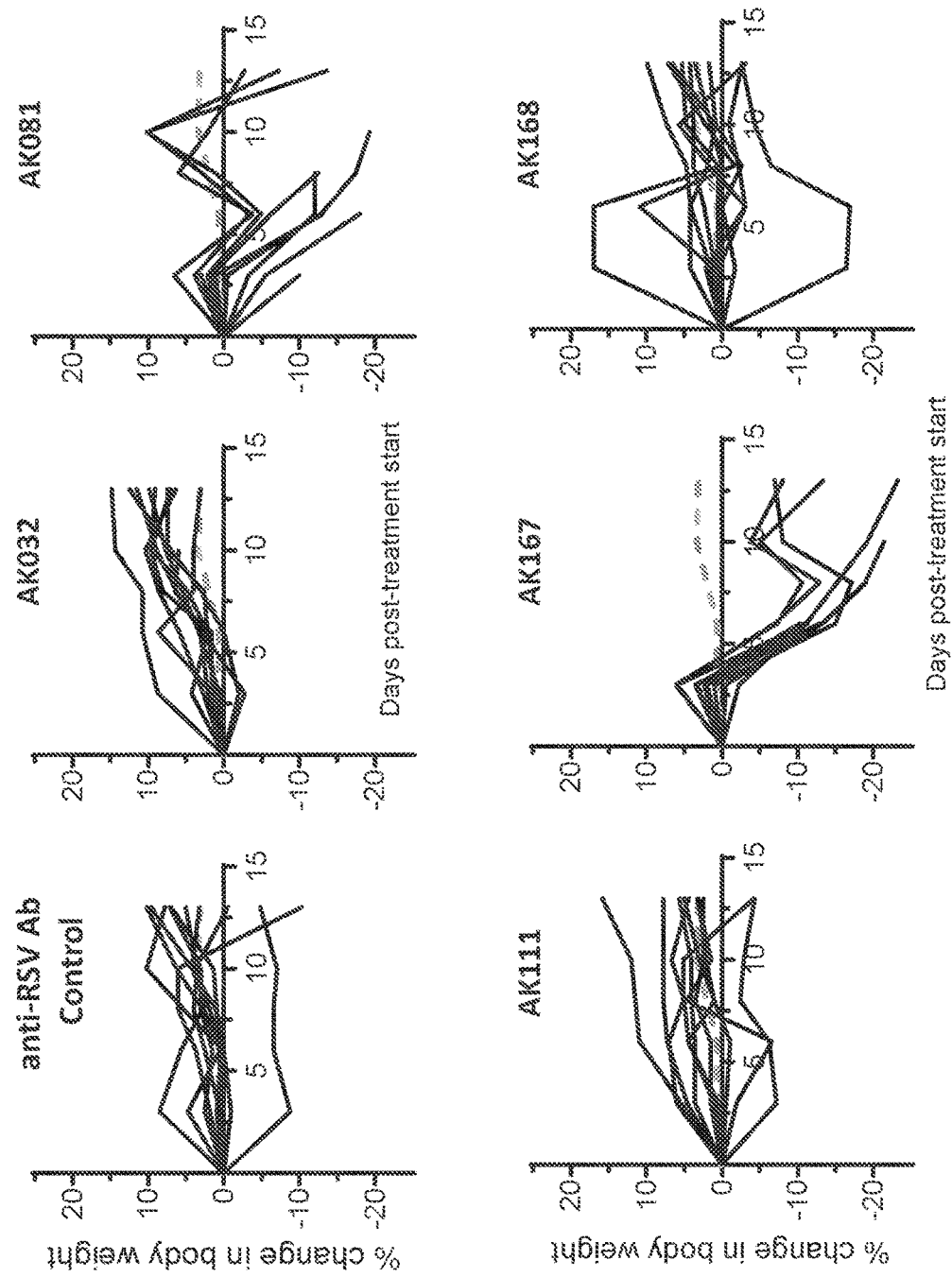

In some studies, a syngeneic tumor model was used to assess the ability of masked IL-2 polypeptide constructs to reduce tumor volume in accordance with the following method. C57BL/6 female mice were purchased from Charles River Laboratories and were 8-10 weeks old at the start of study. MC38 tumor cells (5×105 cells per mouse) were injected subcutaneously into the right flank of each mouse. Upon reaching ~125 mm3 sized tumors (day 0), the mice were randomized to receive 2 mg/kg doses of AK081, AK111, AK167, or AK168, or an anti-RSV antibody as a control, in PBS. Mice were dosed intraperitoneally, three times a week for 6 doses. Tumor volume was calculated (Length*(Width^2)/2) using dial calipers and body weights were recorded twice weekly. FIGS. 33A and 33B show results from a syngeneic tumor model study that assessed tumor volume and body weight over the course of treatment. As shown in FIG. 33A, treatment using exemplary IL-2 polypeptide constructs, including the masked constructs AK111 and AK168, resulted in tumor growth inhibition over time as compared to the anti-RSV control. As shown in FIG. 33B, there was a general lack of body weight reduction observed when the mice were treated with the masked constructs AK111 and AK168.

Bioactivity in Cynomolgus Monkeys

The in vivo bioactivity of the masked IL-2 polypeptide constructs and the masked IL-15 polypeptide constructs generated in Example 1 is assessed in vivo in cynomolgus monkeys. Cynomolgus monkeys are treated with the constructs and in vivo bioactivity, pharmacokinetics, and cleavage is assessed. In some experiments, some monkeys are treated with controls for comparison. In some experiments, some monkeys are treated with aldesleukin as a control for masked IL-2 polypeptide treatment. In some experiments, the monkeys are treated with various doses of the construct, aldesluekin, or other control. Blood is collected from the monkeys at various time points and is then evaluated for certain cell types, such as CD8+ T cells, Memory CD8+ T cells, activated NK cells, CD4+ T cells, and CD4+ Treg cells, and/or markers of interest, such as for the dose-response of total lymphocytes, Ki67+, and of soluble CD25. In some experiments, the longitudinal kinetics of the proliferation and expansion of certain circulating T and NK cell types is assessed. In some experiments, pharmacokinetics and cleavage of the masked IL-2 polypeptide constructs and the masked IL-15 polypeptide constructs are determined by ELISA, PAGE, and mass spectrometry.

To test the safety profile of exemplary masked IL-2 polypeptide constructs in non-human primates, a dose ranging study is performed in accordance with the following method. Groups of 3 healthy male cynomolgus monkeys (*Macaca fascicularis*) are randomly assigned to receive a single intravenous bolus dose of 2 mL/kg of activatable (i.e., cleavable) masked IL-2 polypeptide proteins or non-cleavable masked IL-2 polypeptide proteins at 10, 30 and 100 nmol/kg in 100 mM sodium citrate buffer (pH 5.5). A third group receives the parental non-masked, cleavable protein at 3, 10 and 30 nmol/kg as a positive control. This third group is dosed at a lower range to account for higher potency of the parental non-masked molecules. Doses are calculated in moles to account for differences in molecular weight. Blood samples are collected before dosing and 1, 24, 48, 72, 96, 168, 264 and 336 hours post-dosing. An automated hematology analyzer is used to monitor changes in lymphocyte subsets and serum chemistry. Total and intact (i.e., non-cleaved) drug levels are measured from plasma using custom ELISA as described above. Soluble CD25 levels are measured with an ELISA (R&D systems, cat #DR2A00) to monitor immune stimulation. Plasma levels of inflammatory cytokines are quantified using custom multiplexed electrochemiluminescence assay (Meso Scale Discovery). Blood pressure is monitored as an indicator of vascular leak syndrome. PK is analyzed using an ELISA that captures IL-2 and detects human Fc and by an ELISA that captures human Fc and detects human Fc.

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

IX. SEQUENCES

| SEQ ID | AMINO ACID SEQUENCE |
|---|---|
| 1 | APTSSSTKKTQLQLEHLLLDLQMILNGINNYKNPKLTRMLTFKFYMPKKATELKHLQCLE EELKPLEEVLNLAQSKNFHLRPRDLISNINVIVLELKGSETTFMCEYADETATIVEFLNRWI TFAQSIISTLT |
| 2 | APTSSSTKKTQLQLEHLLLDLQMILNGINNYKNPKLTRMLTFKFYMPKKATELKHLQCLE EELKPLEEVLNLAQSKNFHFDPRDVVSNINVFVLELKGSETTFMCEYADETATIVEFLNR WITFAQSIISTLT |
| 3 | APTSSSTKKTQLQLEHLLLDLQMILNGINNYKNPKLTAMLTAKFAMPKKATELKHLQCLE EALKPLEEVLNLAQSKNFHLRPRDLISNINVIVLELKGSETTFMCEYADETATIVEFLNRWI TFAQSIISTLT |

-continued

| SEQ ID | AMINO ACID SEQUENCE |
|---|---|
| 4 | APTSSSTKKTQLQLEHLLLDLQMILNGINNYKNPKLTRMLTKKFYMPKKATELKHLQCLE EELKPLEEVLNLAQSKNFHLRPRDLISNINVIVLELKGSETTFMCEYADETATIVEFLNRWI TFAQSIISTLT |
| 5 | APTSSSTKKTQLQLEHLLLDLQMILNGINNYKNPKLTRMLTFAFAMPKKATELKHLQCLE EELKPLEEVLNGAQSKNFHLRPRDLISNINVIVLELKGSETTFMCEYADETATIVEFLNRWI TFAQSIISTLT |
| 6 | APTSSSTKKTQLQLEHLLLDLQMILNGINNYKNPKLTAMLTAKFAMPKKATELKHLQCLE EALKPLEEVLNLAQSKNFHFDPRDVVSNINVFVLELKGSETTFMCEYADETATIVEFLNR WITFAQSIISTLT |
| 7 | APTSSSTKKTQLQLEHLLLDLQMILNGINNYKNPKLTRMLTKKFYMPKKATELKHLQCLE EELKPLEEVLNLAQSKNFHFDPRDVVSNINVFVLELKGSETTFMCEYADETATIVEFLNR WITFAQSIISTLT |
| 8 | APTSSSTKKTQLQLEHLLLDLQMILNGINNYKNPKLTRMLTAKFAMPKKATELKHLQCLE EELKPLEEVLNGAQSKNFHFDPRDVVSNINVFVLELKGSETTFMCEYADETATIVEFLNR WITFAQSIISTLT |
| 9 | ELCDDDPPEIPHATFKAMAYKEGTMLNCECKRGFRRIKSGSLYMLCTGNSSHSSWDNQC QCTSSATRNTTKQVTPQPEEQKERKTTEMQSPMQPVDQASLPGHCREPPPWENEATERIY HFVVGQMVYYQCVQGYRALHRGPAESVCKMTHGKTRWTQPQLICT |
| 10 | AVNGTSQFTCFYNSRANISCVWSQDGALQDTSCQVHAWPDRRRWNQTCELLPVSQASW ACNLILGAPDSQKLTTVDIVTLRVLCREGVRWRVMAIQDFKPFENLRLMAPISLQVVHVE THRCNISWEISQASHYFERHLEFEARTLSPGHTWEEAPLLTLKQKQEWICLETLTPDTQYE FQVRVKPLQ |
| 11 | GGSSPPMPYDLYHPSGP |
| 12 | GSPMPYDLYHP |
| 13 | GSPPMPYDLYHPSGP |
| 14 | GSPSMPYDLYHPSGP |
| 15 | GPPSGSSPMPYDLYHPSGGG |
| 16 | GSSGGPPGGMPYDLYHPSGGG |
| 17 | SGSPSGSGGGMPYDLYHPSGGG |
| 18 | GPPGPPGSSGMPYDLYHPSGGG |
| 19 | GSSSGPPGPPSMPYDLYHPSGGG |
| 20 | PA |
| 21 | GGGGSGGGGSGGGGS |
| 22 | PSGPSAGGAA |
| 23 | GGPPASAGS |
| 24 | GSPPAGGAP |
| 25 | GPGSGSGGAA |
| 26 | GGGGSGGGGS |
| 27 | GGGGSGGGGSGGGGSGGGGS |
| 28 | PGSGS |
| 29 | GGGGGGGGGGGGGGGGGGGGGGGGGGGGGGGG |
| 30 | GGGGSGGGGSGGGGSGGGGSGGGGS |
| 31 | GGGGSGGGGSGGGGSGGGGSGGGGSGGGGS |
| 32 | GGGGSGGGGSGGGGSGGGGSGGGGSGGGGSGGGGS |

IX. SEQUENCES

| SEQ ID | AMINO ACID SEQUENCE |
|---|---|
| 33 | GGGGSGGGGSGGGGSGGGGSGGGGSGGGGSGGGGSGGGGS |
| 34 | GGSSPP |
| 35 | SGP |
| 36 | GSP |
| 37 | GSPP |
| 38 | GSPS |
| 39 | GPPSGSSP |
| 40 | GSSGGPPGG |
| 41 | SGSPSGSGGG |
| 42 | GPPGPPGSSG |
| 43 | SGGG |
| 44 | GSSSGPPGPPS |
| 45 | GGS |
| 46 | GGGSSGGS |
| 47 | GGSGG |
| 48 | GGGS |
| 49 | GS |
| 50 | GSGGGSSGGS |
| 51 | GSSGGS |
| 52 | GGGSSGGSG |
| 53 | GGSAGGS |
| 54 | GHS |
| 55 | GPS |
| 56 | GAS |
| 57 | SGG |
| 58 | SGGSGG |
| 59 | SSG |
| 60 | GGGSGG |
| 61 | GG |
| 62 | GGG |
| 63 | SHGG |
| 64 | HGGG |
| 65 | SGAA |
| 66 | SGPA |
| 67 | GGSGGS |
| 68 | GGSGGP |
| 69 | GGSGGG |

| SEQ ID | AMINO ACID SEQUENCE |
|---|---|
| 70 | GSGGPGPS |
| 71 | SGPPGSS |
| 72 | SSGGSGP |
| 73 | SSPSPSGG |
| 74 | SPGGSS |
| 75 | GGPGSSP |
| 76 | SGPPGGPSS |
| 77 | GPGPGSPPGGSS |
| 78 | SGPP |
| 79 | PGSPSSS |
| 80 | PSPGGPS |
| 81 | GGPPS |
| 82 | PSPPSS |
| 83 | SGGPGP |
| 84 | GPSPGS |
| 85 | GSPGPSP |
| 86 | PSSGGSS |
| 87 | SGSSGP |
| 88 | GGSSSPP |
| 89 | GSPGSP |
| 90 | PPPS |
| 91 | APPPS |
| 92 | AAPPPS |
| 93 | SAPPPS |
| 94 | SSGP |
| 95 | SSPGP |
| 96 | MPYDLYHP |
| 97 | GGIGQLTA |
| 98 | DLGRFQTF |
| 99 | DSGGFMLT |
| 100 | TSVLMAAP |
| 101 | TSEFVFAPDQ |
| 102 | KLVLPVLP |
| 103 | KPILFFRL |
| 104 | ANQLKG |
| 105 | QSQLKE |
| 106 | HEQLTV |

-continued

| IX. SEQUENCES | |
|---|---|
| SEQ ID | AMINO ACID SEQUENCE |
| 107 | PANLVAPDP |
| 108 | PAPGVYPGP |
| 109 | APAGLIVPYN |
| 110 | PQALVA |
| 111 | VGNLNF |
| 112 | VANLLYE |
| 113 | VYNLMD |
| 114 | TFNIKQ |
| 115 | DLWKLLP |
| 116 | PGSTKRA |
| 117 | QQYRALKS |
| 118 | YVPRAVL |
| 119 | GVNKWPT |
| 120 | LAQAVRSS |
| 121 | RAAAVKSP |
| 122 | DLLAVVAAS |
| 123 | VQTVTWPD |
| 124 | AIPMSIPP |
| 125 | GYEVHHQK |
| 126 | VHHQKLVF |
| 127 | IRRVSYSF |
| 128 | MPYDLYHPILFFRL |
| 129 | GGIGQLTSVLMAAP |
| 130 | DSGGFMLTLVLPVLP |
| 131 | TSEFVFAPDLGRFQTF |
| 132 | TSTSGRSANPR |
| 133 | TSTSGRSANPG |
| 134 | TSTSGRSANPH |
| 135 | VPLSLY |
| 136 | TSASGASASAA |
| 137 | PSSPGGGSSP |
| 138 | ISSGLLSGRSDNH |
| 139 | ISSGLLSGRSDDH |
| 140 | ISSGLLSGRSDIH |
| 141 | ISSGLLSGRSDQH |
| 142 | ISSGLLSGRSDTH |
| 143 | ISSGLLSGRSANP |

IX. SEQUENCES

| SEQ ID | AMINO ACID SEQUENCE |
|---|---|
| 144 | ISSGLLSGRSDNP |
| 145 | ISSGLLSGRSANPRG |
| 146 | AVGLLAPPGGLSGRSDNH |
| 147 | AVGLLAPPGGLSGRSDDH |
| 148 | AVGLLAPPGGLSGRSDIH |
| 149 | AVGLLAPPGGLSGRSDQH |
| 150 | AVGLLAPPGGLSGRSDTH |
| 151 | AVGLLAPPGGLSGRSANP |
| 152 | AVGLLAPPGGLSGRSDNP |
| 153 | AVGLLAPPSGRSANPRG |
| 154 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPG |
| 155 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPG |
| 156 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPG |
| 157 | EIVLTQSPDFQSVTPKEKVTITCSANSALSYMYWYQQKPDQSPKLWVHGTSNLASGVPSR FSGSGSGTDFTLTINSLEAEDAATYYCHHWSNTQWTFGGGTKVEIKRTVAAPSVFIFPPSD EQLKSGTASVVCLLNNFYPREAKVQWKVDNALQSGNSQESVTEQDSKDSTYSLSSTLTLS KADYEKHKVYACEVTHQGLSSPVTKSFNRGEC |
| 158 | QVQLVQSGAEVKKPGSSVKVSCKASGYTFTNYFMNWVRQAPGQGLEWMGRVDPEQGR ADYAEKFKKRVTITADKSTSTAYMELSSLRSEDTAVYYCARRAMDNYGFAYWGQGTLV TVSSASTKGPSVFPLAPSSKSTSGGTAALGCLVKDYFPEPVTVSWNSGALTSGVHTFPAVL QSSGLYSLSSVVTVPSSSLGTQTYICNVNHKPSNTKVDKKVEPKSCDKTHTCPPCPAPELL GGPDVFLFPPKPKDTLMISRTPEVTCVVVDVSHEDPEVKFNWYVDGVEVHNAKTKPREE QYNSTYRVVSVLTVLHQDWLNGKEYKCKVSNKALPAPEEKTISKAKGQPREPQVYTLPP SRDELTKNQVSLTCLVKGFYPSDIAVEWESNGQPENNYKTTPPVLDSDGSFFLYSKLTVD KSRWQQGNVFSCSVMHEALHNHYTQKSLSLSPGK |
| 159 | MYRMQLLSCIALSLALVTNSAPTSSSTKKTQLQLEHLLLDLQMILNGINNYKNPKLTRML TFKFYMPKKATELKHLQCLEEELKPLEEVLNLAQSKNFHLRPRDLISNINVIVLELKGSET TFMCEYADETATIVEFLNRWITFCQSIISTLT |
| 160 | APTSSSTKKTQLQLEHLLLDLQMILNGINNYKNPKLTRMLTFKFYMPKKATELKHLQCLE EELKPLEEVLNLAQSKNFHLRPRDLISNINVIVLELKGSETTFMCEYADETATIVEFLNRWI TFCQSIISTLT |
| 161 | CGGHQYERRGGC |
| 162 | CSGHQYERREGC |
| 163 | CGGHYFERHGGC |
| 164 | CSGHYFERHEGC |
| 165 | CSFHQYERHEGC |
| 166 | MRISKPHLRSISIQCYLCLLLNSHFLTEAGIHVFILGCFSAGLPKTEANWVNVISDLKKIEDL IQSMHIDATLYTESDVHPSCKVTAMKCFLLELQVISLESGDASIHDTVENLIILANNSLSSN GNVTESGCKECEELEEKNIKEFLQSFVHIVQMFINTS |
| 167 | NWVNVISDLKKIEDLIQSMHIDATLYTESDVHPSCKVTAMKCFLLELQVISLESGDASIHD TVENLIILANNSLSSNGNVTESGCKECEELEEKNIKEFLQSFVHIVQMFINTS |

IX. SEQUENCES

| SEQ ID | AMINO ACID SEQUENCE |
|---|---|
| 168 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 169 | DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 170 | TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 171 | DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQGLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVGSKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDCLSVFLNQLCVLHEKTPVSDRVTKCCTESLVNGRPCFSALEVDETYVPKEFNAETFTFHADICTLSEKERQIKKQTALVELVKHKPKATKEQLKAVMDDFAAFVEKCCKADDKETCFAEEGKKLVAASQAALGL |
| 172 | LAEAKVLANRELDKYGVSDYYKNLINNAKTVEGVKALIDEILAALP |
| 173 | DICLPRWGCLW |
| 174 | RLIEDICLPRWGCLWEDD |
| 175 | DCAWHLGELVWCT |
| 176 | NKFRGKYK |
| 177 | NARKFYKG |
| 178 | FYWHCLDE |
| 179 | FYCHWALE |
| 180 | FYCHTIDE |
| 181 | AQQNAFYQVLNMPNLNADQRNGFIQSLKDDPSQSANVLGEAQKLNDSQAPK |
| 182 | ADAQQNKFNKDQQSAFYEILNMPNLNEEQRNGFIQSLKDDPSQSTNVLGEAKKLNESQAPK |
| 183 | ADNNFNKEQQNAFYEILNMPNLNEEQRNGFIQSLKDDPSQSANLLAEAKKLNESQAPK |
| 184 | ADNKFNKEQQNAFYEILHLPNLNEEQRNGFIQSLKDDPSQSANLLAEAKKLNDAQAPK |
| 185 | ADNKFNKEQQNAFYEILHLPNLTEEQRNGFIQSLKDDPSVSKEILAEAKKLNDAQAPK |
| 186 | VDNKFNKEQQNAFYEILHLPNLNEEQRNAFIQSLKDDPSQSANLLAEAKKLNDAQAPK |
| 187 | QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCAREDWLGEADYGMDVWGQGTTVTVSS |
| 188 | DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPTFGQGTKVEIKR |
| 189 | QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARDGEQWRGFDYWGQGTTVTVSS |

| IX. SEQUENCES | |
|---|---|
| SEQ ID | AMINO ACID SEQUENCE |
| 190 | DIVMTQTPLSSPVTLGQPASISCRSSQSLVHSDGNTYLSWLQQRPGQPPRLLIYKISNRFSG VPDRFSGSGAGTDFTLKISRVEAEDVGVYYCMQATQFPTFGQGTKVEIKR |
| 191 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCARDQEQWRLAFDYWGQGTT VTVSS |
| 192 | DIVMTQTPLSSPVTLGQPASISCRSSQSLVHSDGNTYLSWLQQRPGQPPRLLIYKISNRFSG VPDRFSGSGAGTDFTLKISRVEAEDVGVYYCMQATQFPTFGQGTKVEIKR |
| 193 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCARGAVAGTGRDYYYYGMDV WGQGTTVTVSS |
| 194 | DIVMTQSPLSLPVTPGEPASISCRSSQSLLHSNGYNYLDWYLQKPGQSPQLLIYLGSNRAS GVPDRFSGSGSGTDFTLKISRVEAEDVGVYYCMQALQTPLTFGGGTKVEIKR |
| 195 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCARGSYYDSSGYYYGEDFDYW GQGTTVTVSS |
| 196 | DIVMTQTPLSSPVTLGQPASISCRSSQSLVHSDGNTYLSWLQQRPGQPPRLLIYKISNRFSG VPDRFSGSGAGTDFTLKISRVEAEDVGVYYCMQTSQFPTFGQGTKVEIKR |
| 197 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCAREEWELEDYGMDVWGQGT TVTVSS |
| 198 | DIVMTQTPLSSPVTLGQPASISCRSSQSLVHSDGNTYLSWLQQRPGQPPRLLIYKISNRFSG VPDRFSGSGAGTDFTLKISRVEAEDVGVYYCMQTTQFPTFGQGTKVEIKR |
| 199 | QVQLVESGGGVVQPGRSLRLSCAASGFTFSSYGMHWVRQAPGKGLEWVAVIWYDGSNK YYADSVKGRFTISRDNSKNTLYLQMNSLRAEDTAVYYCAREDFDSHYGMDVWGQGTTV TVSS |
| 200 | DIVMTQTPLSSPVTLGQPASISCRSSQSLVHSDGNTYLSWLQQRPGQPPRLLIYKISNRFSG VPDRFSGSGAGTDFTLKISRVEAEDVGVYYCMQTTQFPTFGQGTKVEIKR |
| 201 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCARDNWGSDAFDIWGQGTTVT VSS |
| 202 | DIVMTQTPLSSPVTLGQPASISCRSSQSLVHSDGNTYLSWLQQRPGQPPRLLIYKISNRFSG VPDRFSGSGAGTDFTLKISRVEAEDVGVYYCMQVTQFPTFGQGTKVEIKR |
| 203 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCARDDWFGEADYGMDVWGQG TTVTVSS |
| 204 | DIVMTQTPLSSPVTLGQPASISCRSSQSLVHSDGNTYLSWLQQRPGQPPRLLIYKISNRFSG VPDRFSGSGAGTDFTLKISRVEAEDVGVYYCMQTTQFPTFGQGTKVEIKR |
| 205 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCARRISITPFDYWGQGTTVTVSS |
| 206 | EIVLTQSPGTLSLSPGERATLSCRASQSVSSSYLAWYQQKPGQAPRLLIYGASSRATGIPDR FSGSGSGTDFTLTISRLEPEDFAVYYCQQYGSSPLTFGGGTKVEIKR |
| 207 | EVQLVQSGAEVKKPGESLKISCKGSGYSFTSYWIGWVRQMPGKGLEWMGIIYPGDSDTR YSPSFQGQVTISADKSISTAYLQWSSLKASDTAMYYCARQQVAGMLDYWGQGTTVTVSS |
| 208 | EIVLTQSPGTLSLSPGERATLSCRASQSVSSSYLAWYQQKPGQAPRLLIYGASSRATGIPDR FSGSGSGTDFTLTISRLEPEDFAVYYCQQYGSSPLTFGGGTKVEIKR |
| 209 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCARDDFWSDYPFDYWGQGTTV TVSS |
| 210 | DIVMTQTPLSSPVTLGQPASISCRSSQSLVHSDGNTYLSWLQQRPGQPPRLLIYKISNRFSG VPDRFSGSGAGTDFTLKISRVEAEDVGVYYCMQTTQFPTFGQGTKVEIKR |

| | IX. SEQUENCES |
|---|---|
| SEQ ID | AMINO ACID SEQUENCE |
| 211 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCAREEWFGEADYGMDVWGQG TTVTVSS |
| 212 | DIVMTQTPLSSPVTLGQPASISCRSSQSLVHSDGNTYLSWLQQRPGQPPRLLIYKISNRFSG VPDRFSGSGAGTDFTLKISRVEAEDVGVYYCMQTTQFPTFGQGTKVEIKR |
| 213 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCARGAVAGTGRDYYYYGMDV WGQGTTVTVSS |
| 214 | DIVMTQSPLSLPVTPGEPASISCRSSQSLLHSNGYNYLDWYLQKPGQSPQLLIYLGSNRAS GVPDRFSGSGSGTDFTLKLISRVEAEDVGVYYCMQALQTPLTFGGGTKVEIKR |
| 215 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCARGSYYDSSGYYFGEDFDYW GQGTTVTVSS |
| 216 | DIVMTQTPLSSPVTLGQPASISCRSSQSLVHSDGNTYLSWLQQRPGQPPRLLIYKISNRFSG VPDRFSGSGAGTDFTLKISRVEAEDVGVYYCMQVTQFPTFGQGTKVEIKR |
| 217 | QVQLVESGGGVVQPGRSLRLSCAASGFTFSIYGMHWVRQAPGKGLEWVTVIWYDGSNE YYADSVKGRFTISRDNSKNTLYLQMNSLRAEDTAVYYCARGTVAGTGRDYYYYGMDV WGQGTTVTVSS |
| 218 | DIVMTQSPLSLPVTPGEPASISCRSSQSLLHSNGYNYLDWYLQKPGQSPQLLIYLGSNRAS GVPDRFSGSGSGTDFTLKLISRVEAEDVGVYYCMQALQTPLTFGGGTKVEIKR |
| 219 | EIVLTQSPGTLSLSPGERATLSCRASQSVSSSYLAWYQQKPGQAPRLLIYGASSRATGIPDR FSGSGSGTDFTLTISRLEPEDFAVYYCQQYGSSHTFGQGTKLEISR |
| 220 | EVQLVQSGAEVKKPGESLKISCKGSGYSFTSYWIGWVRQMPGKGLEWMGIIYPGDSDTR YSPSFQGQVTISADKSISTAYLQWSSLKASDTAMYYCARGGNWNCFDYWGQGTLVTVSS |
| 221 | GMLSLAVNGTSQFTCFYNSRANISCVWSQDGALQDTSCQVHAWPDRRRWNQTCELLPV SQASWACNLILGAPDSQKLTTVDIVTLRVLCREGVRWRVMAIQDFKPFENLRLMAPISLQ VVHVETHRCNISWEISQASHYFERHLEFEARTLSPGHTWEEAPLLTLKQKQEWICLETLTP DTQYEFQVRVKPLQAFRTLTGH |
| 222 | QKLTTVDI |
| 223 | CQKLTTVDIC |
| 224 | SHYFER |
| 225 | CSHYFERC |
| 226 | AVNGTSQFTCFYNSRANISCVWSQDGALQDTSCQVHAWPDRRRWNQTCELLPVSQASW ACNLILGAPDSQKLTTVDIVTLRVLCREGVRWRVMAIQDF |
| 227 | LNTTILTPNGNEDTTADFFLTTMPTDSLSVSTLPLPEVQCFVFNVEYMNCTWNSSSEPQPT NLTLHYWYKNSDNDKVQKCSHYLFSEEITSGCQLQKKEIHLYQTFVVQLQDPREPRRQA TQMLKLQNLVIPWAPENLTLHKLSESQLELNWNNRFLN HCLEHLVQYRTDWDHSWTEQSVDYRHKFSL PSVDGQKRYTFRVRSRFNPLCGSAQHWSEW SHPIHWGSNTSKENPFLFALEAV |
| 228 | TLPLPEVQCFVFNVEYMNCTWNSSSEPQPTNLTLHYWYKNSDNDKVQKCSHYLFSEEITS GCQLQKKEIHLYQTFVVQLQDPREPRRQATQMLKLQNLVIPWAPENLTLHKLSESQLELN WNNRFLNHCLEHLVQYRTDWDHSWTEQSVDYRHKFSLPSVDGQKRYTFRVRSRFNPLC GSAQHWSEWSHPIHWGSNT |
| 229 | TLPLPEVQCFVFNVEYMNCTWNSSSEPQPTNLTLHYWYKNSDNDKVQKCSHYLFSEEITS GCQLQKKEIHLYQTFVVQLQDPREPRRQATQMLKLQNLVI |
| 230 | SSSTKKTQLQLEHLLLDLQMILNGINNYKNPKLTRMLTFKFYMPKKATELKHLQCLEEEL KPLEEVLNLAQSKNFHLRPRDLISNINVIVLELKGSETTFMCEYADETATIVEFLNRWITFC QSIISTLT |
| 231 | ELCDDDPPEIPHATFKAMAYKEGTMLNCECKRGFRRIKSGSLYMLCTGNSSHSSWDNQC QCTSSATRNTTKQVTPQPEEQKERKTTEMQSPMQPVDQASLPGHCREPPPWENEATERIY HFVVGQMVYYQCVQGYRALHRGPAESVCKMTHGKTRWTQPQLICTGEMETSQFPGEEK PQASPEGRPESETSCLVTTTDFQIQTEMAATMETS |

IX. SEQUENCES

| SEQ ID | AMINO ACID SEQUENCE |
|---|---|
| 232 | ITCPPPMSVEHADIWVKSYSLYSRERYICNSGFKRKAGTSSLTECVLNKATNVAHWTTPSLKCIRDPALVHQRPAPP |
| 233 | ITCPPPMSVEHADIWVKSYSLYSRERYICNSGFKRKAGTSSLTECVLNKATNVAHWTTPSLKCIRDP |
| 234 | ITCPPPMSVEHADIWVKSYSLYSRERYICNSGFKRKAGTSSLTECVLNKATNVAHWTTPSLKCIR |
| 235 | SGGSGGGGSGGGSGGGGSLQ |
| 236 | SGRSA |
| 237 | SGRSANA |
| 238 | SGRNAQ |
| 239 | SGRNAQVR |
| 240 | SGRSDN |
| 241 | SGRSDNPN |
| 242 | GSGKSA |
| 243 | APASSSTKKTQLQLEHLLLDLQMILNGINNYKNPKLTRMLTFKFYMPKKATELKHLQCLEELKPLEEVLNLAQSKNFHLRPRDLISNINIVLELKGSETTFMCEYADETATIVEFLNRWITFAQSIISTLT |
| 244 | APASSSTKKTQLQLEHLLLDLQMILNGINNYKNPKLTRMLTFKFYMPKKATELKHLQCLEELKPLEEVLNLAQSKNFHFDPRDVVSNINVFVLELKGSETTFMCEYADETATIVEFLNRWITFAQSIISTLT |
| 245 | APASSSTKKTQLQLEHLLLDLQMILNGINNYKNPKLTAMLTAKFAMPKKATELKHLQCLEEALKPLEEVLNLAQSKNFHLRPRDLISNINIVLELKGSETTFMCEYADETATIVEFLNRWITFAQSIISTLT |
| 246 | APASSSTKKTQLQLEHLLLDLQMILNGINNYKNPKLTRMLTKKFYMPKKATELKHLQCLEEELKPLEEVLNLAQSKNFHLRPRDLISNINIVLELKGSETTFMCEYADETATIVEFLNRWITFAQSIISTLT |
| 247 | APASSSTKKTQLQLEHLLLDLQMILNGINNYKNPKLTRMLTFAFAMPKKATELKHLQCLEELKPLEEVLNGAQSKNFHLRPRDLISNINIVLELKGSETTFMCEYADETATIVEFLNRWITFAQSIISTLT |
| 248 | APASSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLT |
| 249 | APASSSTKKTQLQLEHLLLDLQMILNGINNYKNPKLTRMLTKKFYMPKKATELKHLQCLEEELKPLEEVLNLAQSKNFHFDPRDVVSNINVFVLELKGSETTFMCEYADETATIVEFLNRWITFAQSIISTLT |
| 250 | APASSSTKKTQLQLEHLLLDLQMILNGINNYKNPKLTRMLTAKFAMPKKATELKHLQCLEEELKPLEEVLNGAQSKNFHFDPRDVVSNINVFVLELKGSETTFMCEYADETATIVEFLNRWITFAQSIISTLT |
| 251 | APASSSTKKTQLQLEHLLLDLQMILNGINNYKNPKLTRMLTFKFYMPKKATELKHLQCLEELKPLEEVLNLAQSKNFHLRPRDLISNINIVLELKGSETTFMCEYADETATIVEFLNRWITFCQSIISTLT |
| 252 | EVQLVESGGGLVQPGGSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS |
| 253 | EVQLVESGGGLVQPGGSLRLSCAASGFTFSSFGMSWVRQAPGKEPEWVSSISGSGSDTLYADSVKGRFTISRDNAKTTLYLQMNSLKPEDTAVYYCTIGGSLSRSSQGTQVTVSS |
| 254 | EVQLVESGGGLVQPGGSLRLSCAASGFTFRSFGMSWVRQAPGKGLEWVSSISGSGSDTLYADSVKGRFTISRDNAKTTLYLQMNSLKPEDTAVYYCTIGGSLSRSSQGTQVTVSS |
| 255 | EVQLVESGGGLVQPGNSLRLSCAASGFTFRSFGMSWVRQAPGKGLEWVSSISGSGSDTLYADSVKGRFTISRDNAKTTLYLQMNSLKPEDTAVYYCTIGGSLSRSSQGTLVTVSS |

| IX. SEQUENCES | |
|---|---|
| SEQ ID | AMINO ACID SEQUENCE |
| 256 | EVQLVESGGGLVQPGNSLRLSCAASGFTFRSFGMSWVRQAPGKGLEWVSSISGSGSDTLY ADSVKGRFTISRDNAKTTLYLQMNSLRPEDTAVYYCTIGGSLSRSSQGTLVTVSS |
| 257 | EVQLVESGGGLVQPGNSLRLSCAASGFTFSSFGMSWVRQAPGKGLEWVSSISGSGSDTLY ADSVKGRETISRDNAKTTLYLQMNSLRPEDTAVYYCTIGGSLSRSSQGTLVTVSS |
| 258 | EVQLVESGGGLVQPGNSLRLSCAASGFTFSSFGMSWVRQAPGKGLEWVSSISGSGSDTLY ADSVKGRETISRDNAKNTLYLQMNSLRPEDTAVYYCTIGGSLSRSSQGTLVTVSS |
| 259 | EVQLVESGGGLVQPGNSLRLSCAASGFTFSSFGMSWVRQAPGKGLEWVSSISGSGSDTLY ADSVKGRFTISRDNAKNTLYLQMNSLRPEDTAVYYCTIGGSLSRSGQGTLVTVSS |
| 260 | TSSSTKKTQLQLEHLLLDLQMILNGINNYKNPKLTAMLTAKFAMPKKATELKHLQCLEE ALKPLEEVLNLAQSKNFHLRPRDLISNINVIVLELKGSETTFMCEYADETATIVEFLNRWIT FAQSIISTLT |
| 261 | AVNGTSQFTCFYNSRANISCVWSQDGALQDTSCQVHAWPDRRRWNQTCELLPVSQASW ACNLILGAPDSQKLTTVDIVTLRVLCREGVRWRVMAIQDFKPFENLRLMAPISLQVVHVE THRCNISWEISQASHYFERHLEFEARTLSPGHTWEEAPLLTLKQKQEWICLETLTPDTQYE FQVRVKPLQGEFTTWSPWSQPLAFRTKPAALGKD |
| 262 | GSGPDSGGFMLTSGPAP |
| 263 | GSSPPGDSGGFMLTSGP |
| 264 | DSGGFMLTS |
| 265 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPGK |
| 266 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVS LWCLVKGFYPSDIAVEWESNGQPENNYKTTPPVLDSDGSFFLYSKLTVDKSRWQQGNVF SCSVMHEALHNHYTQKSLSLSPGGSGPDSGGFMLTSGPAPTSSSTKKTQLQLEHLLLDLQ MILNGINNYKNPKLTAMLTAKFAM PKKATELKHLQCLEEALKPLEEVLNLAQSKNFHLRPRDLISNINVIVLELKGSETTFMCEY ADETATIVEFLNRWITFAQSIISTLT |
| 267 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPGPGSGSAVNGTSQ FTCFYNSRANISCVWSQDGALQDTSCQVHAWPDRRRWNQTCELLPVSQASWACNLILG APDSQKLTTVDIVTLRVLCREGVRWRVMAIQDFKPFENLRLMAPISLQVVHVETHRCNIS WEISQASHYFERHLEFEARTLSPGHTWEEAPLLTLKQKQEWICLETLTPDTQYEFQVRVK PLQGEFTTWSPWSQPLAFRTKPAALGKD |
| 268 | GSGP |
| 269 | GPAP |
| 270 | ISSGLLGGLSGRSDQP |
| 271 | ISSGLLSGRSDQG |
| 272 | ISSGLLSGRSDQA |
| 273 | ISSGLLSGRSDSP |
| 274 | ISSGLLSGRSDTP |
| 275 | ISSGLLSGRSDMP |
| 276 | ISSGLLSGRSD |
| 277 | ISSGLLSGRSDQP |
| 278 | ISSGLLGGLSGRSDNP |
| 279 | ISSGLLSSGGLSGRSDQP |

| IX. SEQUENCES | |
|---|---|
| SEQ ID | AMINO ACID SEQUENCE |
| 280 | ISSGLLSSGGLSGRSDNP |
| 281 | ISSGLLSGRS |
| 282 | ISSGLLSGRSESP |
| 283 | ISSGLLSGRSEQP |
| 284 | ISSGLLSGRSEQH |
| 285 | LSSGLLSGRSDQP |
| 286 | LSSGLLGGLSGRSDQP |
| 287 | LSSGLLSGRSDQG |
| 288 | LSSGLLSGRSDQA |
| 289 | LSSGLLSGRSDSP |
| 290 | LSSGLLSGRSDTP |
| 291 | LSSGLLSGRSDMP |
| 292 | LSSGLLSGRSD |
| 293 | GKQLRVVNEYSSMDNMLLG |
| 294 | LSSGLLGGLSGRSDNP |
| 295 | LSSGLLSSGGLSGRSDQP |
| 296 | LSSGLLSSGGLSGRSDNP |
| 297 | GKQLRVVNEYSSEDNMLLG |
| 298 | LSSGLLSGRSESP |
| 299 | LSSGLLSGRSEQP |
| 300 | LSSGLLSGRSEQH |
| 301 | MPYDLYH |
| 302 | LSGRSDNH |
| 303 | GGGSSP |
| 304 | SGGP |
| 305 | SGPSGSPG |
| 306 | GSIPVSLRSG |
| 307 | GPSGPAGLKGAPG |
| 308 | GPPGPAGMKGLPG |
| 309 | GYVADAPK |
| 310 | KKLADEPE |
| 311 | GGSRPAHLRDSGK |
| 312 | SFTQARVVGG |
| 313 | VHMPLGFLGPRQARVVN |
| 314 | LSGRSDNHSPLGLAGS |
| 315 | VPLSLYSG |
| 316 | IPESLRAG |

-continued

| IX. SEQUENCES | |
|---|---|
| SEQ ID | AMINO ACID SEQUENCE |
| 317 | IPVSLRSG |
| 318 | SGSGGSPVPLSLYSGGP |
| 319 | GGGSSPVPLSLYSGGP |
| 320 | GGSSPPVPLSLYSGPSGSPG |
| 321 | GGSGGSGGGSGGGSGGGSG |
| 322 | GGSGGGSGGGSGGGSGGGSGGGSG |
| 323 | PGPGP |
| 324 | SGGCGGHQYERRGGC |
| 325 | SGGCSGHQYERREGC |
| 326 | SGGCGGHYFERHGGC |
| 327 | SGGCSGHYFERHEGC |
| 328 | SGGCSFHQYERHEGC |
| 329 | PSGSS |
| 330 | GSPG |
| 331 | GGSPGG |
| 332 | GGPGGP |
| 333 | GGSG |
| 334 | GSPPGG |
| 335 | GPGSPG |
| 336 | GSSPPG |
| 337 | GGP |
| 338 | SGPGSGS |
| 339 | GGSSPPGGGSSGGGSGP |
| 340 | SGPGSGS |
| 341 | SGSGGSP |
| 342 | IYDQKT |
| 343 | AHNYKT |
| 344 | MMDQAN |
| 345 | MLGEFVSE |
| 346 | GLVALRGA |
| 347 | KEHKYKAE |
| 348 | GGSSPPGGGSSGGGSGPGSGS |
| 349 | GGSSPPVPLSLYSGPSGS |
| 350 | GNPMGSEPVNFKQLRVVNGGP |
| 351 | GNPMGSEPVNFKLLRVVNGGP |
| 352 | GNPMGSDPVNFKQLRVVNGGP |
| 353 | GNPMGSDPVNFKLLRVVNGGP |

-continued

| IX. SEQUENCES | |
|---|---|
| SEQ ID | AMINO ACID SEQUENCE |
| 354 | GGSSPPMPYDLYHPSGPSGSPG |
| 355 | GGSSPPGGGSSGGGSGPSGSPG |
| 356 | RQARVVG |
| 357 | LGGSGRSNAQVRLE |
| 358 | LGGSGRKASLSLE |
| 359 | SGRIGFLRTA |
| 360 | SGAIGFLRTA |
| 361 | RPARSGRSAGGSVA |
| 362 | VTGRGDSPASS |
| 363 | PRFKIIGG |
| 364 | LSGRIGFLRTA |
| 365 | LSGRSNAMPYDLYHP |
| 366 | LSGRSNAGGIGQLTA |
| 367 | LSGRSNAVPLSLY |
| 368 | LSGRSNADSGGFMLT |
| 369 | LSGRSNAHEQLTA |
| 370 | LSGRSNARAAAVKSP |
| 371 | LSGRSNATSVLMAAP |
| 372 | VPLSLYLSGRSNA |
| 373 | DSGGFMLTLSGRSNA |
| 374 | GGIGQLTALSGRSNA |
| 375 | MPYDLYHPLSGRSNA |
| 376 | HEQLTVLSGRSNA |
| 377 | RAAAVKSPLSGRSNA |
| 378 | TSVLMAAPLSGRSNA |
| 379 | IPVSLRSGRSNAQRLE |
| 380 | VPLSLYRQARVVG |
| 381 | DSGGFMLTRQARVVG |
| 382 | GGIGQLTARQARVVG |
| 383 | MPYDLYHPRQARVVG |
| 384 | HEQLTVRQARVVG |
| 385 | RAAAVKSPRQARVVG |
| 386 | TSVLMAAPRQARVVG |
| 387 | KQLRVVNEYSSMDNMLLG |
| 388 | KQLRVVNEYSSEDNMLLG |
| 389 | KQLRVVNGYSSEDNMLLG |
| 390 | KQLRVVGGLVHLKNTMET |

-continued

IX. SEQUENCES

| SEQ ID | AMINO ACID SEQUENCE |
|---|---|
| 391 | TRDRLDEVNFKQLRVVNG |
| 392 | TRDRLDEVNFKLLRVVNG |
| 393 | TRDRLDPVNFKQLRVVNG |
| 394 | TRDRLDPVNFKLLRVVNG |
| 395 | NPMGSEPVNFKQLRVVNG |
| 396 | NPMGSEPVNFKLLRVVNG |
| 397 | NPMGSDPVNFKQLRVVNG |
| 398 | NPMGSDPVNFKLLRVVNG |
| 399 | TYSRSKYLATA |
| 400 | TYSRSRYLATA |
| 401 | KQLRVVNEYSSE |
| 402 | KQLRVVNGYSSE |
| 403 | KQLRVVGGLVAL |
| 404 | KQLRVVNGLVAL |
| 405 | SPGRVVGGLVAL |
| 406 | PQPRTYSRSRYL |
| 407 | PQPRTTSRSRYL |
| 408 | VVNEYSSSRGPYH |
| 409 | VVNEYSSERGPYH |
| 410 | NKVSMSSSRGPYH |
| 411 | NKVSMSSTRGPYH |
| 412 | APAMMRGSVILTV |
| 413 | APAMMEGSVILTV |
| 414 | RGSVIITVQTVTW |
| 415 | RGSVILTVQTVTW |
| 416 | GTRDRLDEVNFKQLRVVNGGP |
| 417 | GTRDRLDEVNFKLLRVVNGGP |
| 418 | GTRDRLDPVNFKQLRVVNGGP |
| 419 | GTRDRLDPVNFKLLRVVNGGP |
| 420 | RKGKALAAYRLE |
| 421 | RKGKAGAAYRLE |
| 422 | RQARVVGGLVAL |
| 423 | GGVRGPRFKIIGG |
| 424 | GGVRGPRVKIIGG |
| 425 | VTGRGDSHSLTTN |
| 426 | VTGRGDSPSLTTN |
| 427 | TGHGQASQGLLDR |

-continued

| SEQ ID | AMINO ACID SEQUENCE |
|---|---|
| 428 | TGHGQASSGLLDR |
| 429 | KQLRVVNENLENY |
| 430 | KQLRVVNGNLENY |
| 431 | SNVNDVANYNFF |
| 432 | SNVNDVSNYNFF |
| 433 | IDFNAAQNLYEK |
| 434 | IDFNAAYNLYEK |
| 435 | IQWNAGQPLQER |
| 436 | IQWNAPQPLQER |
| 437 | SMDNRLLGLFGE |
| 438 | SMDNMLLGLFGE |
| 439 | VPIDDPQDLLEG |
| 440 | VPIDDPEDLLEG |
| 441 | IPENLPPGLPLT |
| 442 | IPENLPPLLPLT |
| 443 | QPPSLTKNQVSL |
| 444 | QPPSLTRNQVSL |
| 445 | DSHSLTKNQVSL |
| 446 | DSHSLTTNQVSL |
| 447 | KAIQLTKNQVSL |
| 448 | KAIQLTYNQVSL |
| 449 | AEPWTNRNTDGS |
| 450 | AEPWTVRNTDGS |
| 451 | KQLRVVNG |
| 452 | KQLRVVTGRGDSP |
| 453 | KQLRVVNGRGDSP |
| 454 | PSSRRRVVRKGVS |
| 455 | PSSRRRVNRKGVS |
| 456 | SPGRVVTGRGDSP |
| 457 | SPGRVVGGRGDSP |
| 458 | NSGRAVTGRGDSP |
| 459 | NSGRAVTYRGDSP |
| 460 | TGHGQPSSRRRVN |
| 461 | TGHGQASSRRRVN |
| 462 | TGHGQSSRGPYH |
| 463 | TGHGQASSRGPYH |
| 464 | RGSVILTKNQVSL |

-continued

| SEQ ID | AMINO ACID SEQUENCE |
|---|---|
| 465 | RGSVILTVNQVSL |
| 466 | SPGRVVGINYWLA |
| 467 | SPGRVVGGNYWLA |
| 468 | SPGRVVGSNKGAI |
| 469 | SPGRVVGGNKGAI |
| 470 | PGARGRAPNHAVV |
| 471 | PGARGRAFNHAVV |
| 472 | PGARGNAFNNLDR |
| 473 | PGARGRAFNNLDR |
| 474 | VSNKYISNNEQLP |
| 475 | VSNKYFSNNEQLP |
| 476 | KVSNKALHVTNI |
| 477 | KVSNKALPVTNI |
| 478 | VTGRGPSPDVPLT |
| 479 | VTGRGDSPDVPLT |
| 480 | TGHGQRSSNIRTS |
| 481 | TGHGQASSNIRTS |
| 482 | TGHGQHSSNIANI |
| 483 | TGHGQASSNIANI |
| 484 | TGHGQASRNDYSY |
| 485 | TGHGQASSNDYSY |
| 486 | KALHVTNRNTDGS |
| 487 | KALHVTNINTDGS |
| 488 | RVVRKKVSNKALP |
| 489 | RVVRKGVSNKALP |
| 490 | RQARVVGMYWLA |
| 491 | RQARVVGGNYWLA |
| 492 | GKQLRVVNGYSSEDNMLLGGP |
| 493 | GKQLRVVGGLVHLKNTMETGP |
| 494 | AGQPKQLRVVNG |
| 495 | AGQPLQLRVVNG |
| 496 | AGQPLQERVVNG |
| 497 | AGQPKQERVVNG |
| 498 | GTANKQLRVVNG |
| 499 | GTANKQLHVVNG |
| 500 | GTANIQLRVVNG |
| 501 | GTANIQLHVVNG |

-continued

IX. SEQUENCES

| SEQ ID | AMINO ACID SEQUENCE |
|---|---|
| 502 | GKQLRVVNEYSSMDNMLLGGP |
| 503 | GKQLRVVNEYSSEDNMLLGGP |
| 504 | KQLRTVAGLAGK |
| 505 | KQLRTVNGLAGK |
| 506 | KQLRVVAGLAGK |
| 507 | KQLRVVNGLAGK |
| 508 | GIKYKQLRVVNG |
| 509 | GIKYKYLRVVNG |
| 510 | GIKYLQLRVVNG |
| 511 | GIKYLYLRVVNG |
| 512 | THLDLTYSRSKYLATA |
| 513 | THLDLTPSRSKYLATA |
| 514 | THLDLTYSRSRYLATA |
| 515 | THLDLTPSRSRYLATA |
| 516 | TYSRSKYLAPANGNAE |
| 517 | TYSRSKYLATANGNAE |
| 518 | TYSRSRYLAPANGNAE |
| 519 | TYSRSRYLATANGNAE |
| 520 | DPVNFKQLRVVNEYSSE |
| 521 | DPVNFKQLRVVNGYSSE |
| 522 | DPVNFKKLRVVNEYSSE |
| 523 | DPVNFKKLRVVNGYSSE |
| 524 | RKGKAGAAKNLNEKDY |
| 525 | RKGKAGAAKNLYEKDY |
| 526 | RKGKAGAAQNLNEKDY |
| 527 | RKGKAGAAQNLYEKDY |
| 528 | VTGRGDSHSLTKNQVSL |
| 529 | VTGRGDSHSLTTNQVSL |
| 530 | VTGRGDSPSLTKNQVSL |
| 531 | VTGRGDSPSLTTNQVSL |
| 532 | TGHGQASSERSSNIRTS |
| 533 | TGHGQASSERSSNSRTS |
| 534 | TGHGQASSERSSTIRTS |
| 535 | TGHGQASSERSSTSRTS |
| 536 | GISSGLLSGRSDQPSGP |
| 537 | GGSGISSGLLSGRSDQPSGP |
| 538 | DPVNFKLLRVVNEYSSE |

| | IX. SEQUENCES |
|---|---|
| SEQ ID | AMINO ACID SEQUENCE |
| 539 | DPVNFKLLRVVNGYSSE |
| 540 | DPVNFKQLRVVGGLVAL |
| 541 | DPVNFKQLRVVNGLVAL |
| 542 | DPVNFKLLRVVGGLVAL |
| 543 | DPVNFKLLRVVNGLVAL |
| 544 | KQLRVQNGDSTE |
| 545 | KQLRVVNNDATE |
| 546 | KQLRVVNGDSTE |
| 547 | ISNNKQLRVVNG |
| 548 | ISNNKQLPVVNG |
| 549 | ISNNEQLRVVNG |
| 550 | ISNNEQLPVVNG |
| 551 | KVSNKQLRVVNG |
| 552 | KVSNKQLPVVNG |
| 553 | KVSNKALRVVNG |
| 554 | KVSNKALPVVNG |
| 555 | KQLRVQNNDATE |
| 556 | DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSISTLT |
| 557 | DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGGGGGGGGGGGGGGGGGGGGGGGGGGGGGGGGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT |
| 558 | APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGGGGSGGGGSGGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG |
| 559 | DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT |
| 560 | DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQ |

| SEQ ID | AMINO ACID SEQUENCE |
|---|---|
| | LEHLLLDLQMILNGINNYKNPKLTRMLTKKFYMPKKATELKHLQCLEEELKPLEEVLNLA
QSKNFHLRPRDLISNINVIVLELKGSETTFMCEYADETATIVEFLNRWITFAQSIISTLT |
| 561 | DKTHTCPPCPAPELLGGPSVFLFPPKPKDTLMISRTPEVTCVVVDVSHEDPEVKFNWYVD
GVEVHNAKTKPREEQYASTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGAPTSSSTKKTQLQ
LEHLLLDLQMILNGINNYKNPKLTRMLTFAFAMPKKATELKHLQCLEEELKPLEEVLNGA
QSKNFHLRPRDLISNINVIVLELKGSETTFMCEYADETATIVEFLNRWITFAQSIISTLT |
| 562 | APTSSSTKKTQLQLEHLLLDLQMILNGINNYKNPKLTRMLTFKFYMPKKATELKHLQCLE
EELKPLEEVLNLAQSKNFHLRPRDLISNINVIVLELKGSETTFMCEYADETATIVEFLNRWI
TFAQSIISTLTPSGPSAGGAAEIVLTQSPDFQSVTPKEKVTITCSANSALSYMYWYQQKPD
QSPKLWVHGTSNLASGVPSRFSGSGSGTDFTLTINSLEAEDAATYYCHHWSNTQWTFGG
GTKVEIKRTVAAPSVFIFPPSDEQLKSGTASVVCLLNNFYPREAKVQWKVDNALQSGNSQ
ESVTEQDSKDSTYSLSSTLTLSKADYEKHKVYACEVTHQGLSSPVTKSFNRGEC |
| 563 | ELCDDDPPEIPHATFKAMAYKEGTMLNCECKRGFRRIKSGSLYMLCTGNSSHSSWDNQC
QCTSSATRNTTKQVTPQPEEQKERKTTEMQSPMQPVDQASLPGHCREPPPWENEATERIY
HFVVGQMVYYQCVQGYRALHRGPAESVCKMTHGKTRWTQPQLICTGGPPASAGSQVQL
VQSGAEVKKPGSSVKVSCKASGYTFTNYFMNWVRQAPGQGLEWMGRVDPEQGRADYA
EKFKKRVTITADKSTSTAYMELSSLRSEDTAVYYCARRAMDNYGFAYWGQGTLVTVSS
ASTKGPSVFPLAPSSKSTSGGTAALGCLVKDYFPEPVTVSWNSGALTSGVHTFPAVLQSS
GLYSLSSVVTVPSSSLGTQTYICNVNHKPSNTKVDKKVEPKSCDKTHTCPPCPAPELLGGP
DVFLFPPKPKDTLMISRTPEVTCVVVDVSHEDPEVKFNWYVDGVEVHNAKTKPREEQYN
STYRVVSVLTVLHQDWLNGKEYKCKVSNKALPAPEEKTISKAKGQPREPQVYTLPPSRD
ELTKNQVSLTCLVKGFYPSDIAVEWESNGQPENNYKTTPPVLDSDGSFFLYSKLTVDKSR
WQQGNVFSCSVMHEALHNHYTQKSLSLSPGK |
| 564 | ELCDDDPPEIPHATFKAMAYKEGTMLNCECKRGFRRIKSGSLYMLCTGNSSHSSWDNQC
QCTSSATRNTTKQVTPQPEEQKERKTTEMQSPMQPVDQASLPGHCREPPPWENEATERIY
HFVVGQMVYYQCVQGYRALHRGPAESVCKMTHGKTRWTQPQLICTGSPPAGGAPQVQL
VQSGAEVKKPGSSVKVSCKASGYTFTNYFMNWVRQAPGQGLEWMGRVDPEQGRADYA
EKFKKRVTITADKSTSTAYMELSSLRSEDTAVYYCARRAMDNYGFAYWGQGTLVTVSS
ASTKGPSVFPLAPSSKSTSGGTAALGCLVKDYFPEPVTVSWNSGALTSGVHTFPAVLQSS
GLYSLSSVVTVPSSSLGTQTYICNVNHKPSNTKVDKKVEPKSCDKTHTCPPCPAPELLGGP
DVFLFPPKPKDTLMISRTPEVTCVVVDVSHEDPEVKFNWYVDGVEVHNAKTKPREEQYN
STYRVVSVLTVLHQDWLNGKEYKCKVSNKALPAPEEKTISKAKGQPREPQVYTLPPSRD
ELTKNQVSLTCLVKGFYPSDIAVEWESNGQPENNYKTTPPVLDSDGSFFLYSKLTVDKSR
WQQGNVFSCSVMHEALHNHYTQKSLSLSPGK |
| 565 | APTSSSTKKTQLQLEHLLLDLQMILNGINNYKNPKLTRMLTFKFYMPKKATELKHLQCLE
EELKPLEEVLNLAQSKNFHLRPRDLISNINVIVLELKGSETTFMCEYADETATIVEFLNRWI
TFAQSIISTLTGPGSGGGAAEIVLTQSPDFQSVTPKEKVTITCSANSALSYMYWYQQKPD
QSPKLWVHGTSNLASGVPSRFSGSGSGTDFTLTINSLEAEDAATYYCHHWSNTQWTFGG
GTKVEIKRTVAAPSVFIFPPSDEQLKSGTASVVCLLNNFYPREAKVQWKVDNALQSGNSQ
ESVTEQDSKDSTYSLSSTLTLSKADYEKHKVYACEVTHQGLSSPVTKSFNRGEC |
| 566 | DKTHTCPPCPAPELLGGPSVFLFPPKPKDTLMISRTPEVTCVVVDVSHEDPEVKFNWYVD
GVEVHNAKTKPREEQYASTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGAPTSSSTKKTQLQ
LEHLLLDLQMILNGINNYKNPKLTRMLTFKFYMPKKATELKHLQCLEEELKPLEEVLNLA
QSKNFHLRPRDLISNINVIVLELKGSETTFMCEYADETATIVEFLNRWITFAQSIISTLTGPPS
GSSPMPYDLYHPSGGGAVNGTSQFTCFYNSRANISCVWSQDGALQDTSCQVHAWPDRR
RWNQTCELLPVSQASWACNLILGAPDSQKLTTVDIVTLRVLCREGVRWRVMAIQDFKPF
ENLRLMAPISLQVVHVETHRCNISWEISQASHYFERHLEFEARTLSPGHTWEEAPLLTLKQ
KQEWICLETLTPDTQYEFQVRVKPLQ |
| 567 | DKTHTCPPCPAPELLGGPSVFLFPPKPKDTLMISRTPEVTCVVVDVSHEDPEVKFNWYVD
GVEVHNAKTKPREEQYASTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGPAELCDDDPPEIP
HATFKAMAYKEGTMLNCECKRGFRRIKSGSLYMLCTGNSSHSSWDNQCQCTSSATRNTT
KQVTPQPEEQKERKTTEMQSPMQPVDQASLPGHCREPPPWENEATERIYHFVVGQMVYY
QCVQGYRALHRGPAESVCKMTHGKTRWTQPQLICTGGGGGGGGGGGGGGGGGGGGGG
GGGGGGGGGGGGGGGGAPTSSSTKKTQLQLEHLLLDLQMILNGINNYKNPKLTRMLTFKFY
MPKKATELKHLQCLEEELKPLEEVLNLAQSKNFHLRPRDLISNINVIVLELKGSETTFMCE
YADETATIVEFLNRWITFAQSIISTLTGPPSGSSPMPYDLYHPSGGGAVNGTSQFTCFYNSR
ANISCVWSQDGALQDTSCQVHAWPDRRRWNQTCELLPVSQASWACNLILGAPDSQKLT
TVDIVTLRVLCREGVRWRVMAIQDFKPFENLRLMAPISLQVVHVETHRCNISWEISQASH
YFERHLEFEARTLSPGHTWEEAPLLTLKQKQEWICLETLTPDTQYEFQVRVKPLQ |

IX. SEQUENCES

| SEQ ID | AMINO ACID SEQUENCE |
|---|---|
| 568 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAPTSSSTKKTQLQ LEHLLLDLQMILNGINNYKNPKLTAMLTAKFAMPKKATELKHLQCLEEALKPLEEVLNL AQSKNFHFDPRDVVSNINVFVLELKGSETTFMCEYADETATIVEFLNRWITFAQSIISTLT |
| 569 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAPTSSSTKKTQLQ LEHLLLDLQMILNGINNYKNPKLTRMLTKKFYMPKKATELKHLQCLEEEELKPLEEVLNLA QSKNFHFDPRDVVSNINVFVLELKGSETTFMCEYADETATIVEFLNRWITFAQSIISTLT |
| 570 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAPTSSSTKKTQLQ LEHLLLDLQMILNGINNYKNPKLTRMLTAKFAMPKKATELKHLQCLEEELKPLEEVLNG AQSKNFHFDPRDVVSNINVFVLELKGSETTFMCEYADETATIVEFLNRWITFAQSIISTLT |
| 571 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAELCDDDPPEIP HATFKAMAYKEGTMLNCECKRGFRRIKSGSLYMLCTGNSSHSSWDNQCQCTSSATRNTT KQVTPQPEEQKERKTTEMQSPMQPVDQASLPGHCREPPPWENEATERIYHFVVGQMVYY QCVQGYRALHRGPAESVCKMTHGKTRWTQPQLICTGGGGSGGGGSGGGGSGGGGSGG GGSAPTSSSTKKTQLQLEHLLLDLQMILNGINNYKNPKLTRMLTFKFYMPKKATELKHLQ CLEEEELKPLEEVLNLAQSKNFHLRPRDLISNINVIVLELKGSETTFMCEYADETATIVEFLN RWITFAQSIISTLT |
| 572 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAELCDDDPPEIP HATFKAMAYKEGTMLNCECKRGFRRIKSGSLYMLCTGNSSHSSWDNQCQCTSSATRNTT KQVTPQPEEQKERKTTEMQSPMQPVDQASLPGHCREPPPWENEATERIYHFVVGQMVYY QCVQGYRALHRGPAESVCKMTHGKTRWTQPQLICTGGGGSGGGGSGGGGSGGGGSGG GGSGGGGSAPTSSSTKKTQLQLEHLLLDLQMILNGINNYKNPKLTRMLTFKFYMPKKATE LKHLQCLEEEELKPLEEVLNLAQSKNFHLRPRDLISNINVIVLELKGSETTFMCEYADETATI VEFLNRWITFAQSIISTLT |
| 573 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAELCDDDPPEIP HATFKAMAYKEGTMLNCECKRGFRRIKSGSLYMLCTGNSSHSSWDNQCQCTSSATRNTT KQVTPQPEEQKERKTTEMQSPMQPVDQASLPGHCREPPPWENEATERIYHFVVGQMVYY QCVQGYRALHRGPAESVCKMTHGKTRWTQPQLICTGGGGSGGGGSGGGGSGGGGSGG GGSGGGGSGGGGSAPTSSSTKKTQLQLEHLLLDLQMILNGINNYKNPKLTRMLTFKFYMP KKATELKHLQCLEEEELKPLEEVLNLAQSKNFHLRPRDLISNINVIVLELKGSETTFMCEYA DETATIVEFLNRWITFAQSIISTLT |
| 574 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAELCDDDPPEIP HATFKAMAYKEGTMLNCECKRGFRRIKSGSLYMLCTGNSSHSSWDNQCQCTSSATRNTT KQVTPQPEEQKERKTTEMQSPMQPVDQASLPGHCREPPPWENEATERIYHFVVGQMVYY QCVQGYRALHRGPAESVCKMTHGKTRWTQPQLICTGGGGSGGGGSGGGGSGGGGSGG GGSGGGGSGGGGSGGGGSAPTSSSTKKTQLQLEHLLLDLQMILNGINNYKNPKLTRMLTF KFYMPKKATELKHLQCLEEEELKPLEEVLNLAQSKNFHLRPRDLISNINVIVLELKGSETTF MCEYADETATIVEFLNRWITFAQSIISTLT |
| 575 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAELCDDDPPEIP HATFKAMAYKEGTMLNCECKRGFRRIKSGSLYMLCTGNSSHSSWDNQCQCTSSATRNTT KQVTPQPEEQKERKTTEMQSPMQPVDQASLPGHCREPPPWENEATERIYHFVVGQMVYY QCVQGYRALHRGPAESVCKMTHGKTRWTQPQLICTGGGGGGGGGGGGGGGGGG GGGGGGGGGGGGAPTSSSTKKTQLQLEHLLLDLQMILNGINNYKNPKLTRMLTFKFY |

IX. SEQUENCES

| SEQ ID | AMINO ACID SEQUENCE |
|---|---|
| | MPKKATELKHLQCLEEELKPLEEVLNLAQSKNFHFDPRDVVSNINVFVLELKGSETTFMC EYADETATIVEFLNRWITFAQSIISTLT |
| 576 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGPAELCDDDPPEIP HATFKAMAYKEGTMLNCECKRGFRRIKSGSLYMLCTGNSSHSSWDNQCQCTSSATRNTT KQVTPQPEEQKERKTTEMQSPMQPVDQASLPGHCREPPPWENEATERIYHFVVGQMVYY QCVQGYRALHRGPAESVCKMTHGKTRWTQPQLICTGGGGSGGGGSGGGGSGGGGSGG GGSAPTSSSTKKTQLQLEHLLLDLQMILNGINNYKNPKLTRMLTFKFYMPKKATELKHLQ CLEEELKPLEEVLNLAQSKNFHFDPRDVVSNINVFVLELKGSETTFMCEYADETATIVEFL NRWITFAQSIISTLT |
| 577 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGPAELCDDDPPEIP HATFKAMAYKEGTMLNCECKRGFRRIKSGSLYMLCTGNSSHSSWDNQCQCTSSATRNTT KQVTPQPEEQKERKTTEMQSPMQPVDQASLPGHCREPPPWENEATERIYHFVVGQMVYY QCVQGYRALHRGPAESVCKMTHGKTRWTQPQLICTGGGGSGGGGSGGGGSGGGGSGG GGSGGGGSAPTSSSTKKTQLQLEHLLLDLQMILNGINNYKNPKLTRMLTFKFYMPKKATE LKHLQCLEEELKPLEEVLNLAQSKNFHFDPRDVVSNINVFVLELKGSETTFMCEYADETA TIVEFLNRWITFAQSIISTLT |
| 578 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGPAELCDDDPPEIP HATFKAMAYKEGTMLNCECKRGFRRIKSGSLYMLCTGNSSHSSWDNQCQCTSSATRNTT KQVTPQPEEQKERKTTEMQSPMQPVDQASLPGHCREPPPWENEATERIYHFVVGQMVYY QCVQGYRALHRGPAESVCKMTHGKTRWTQPQLICTGGGGSGGGGSGGGGSGGGGSGG GGSGGGGSGGGGSAPTSSSTKKTQLQLEHLLLDLQMILNGINNYKNPKLTRMLTFKFYMP KKATELKHLQCLEEELKPLEEVLNLAQSKNFHFDPRDVVSNINVFVLELKGSETTFMCEY ADETATIVEFLNRWITFAQSIISTLT |
| 579 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGPAELCDDDPPEIP HATFKAMAYKEGTMLNCECKRGFRRIKSGSLYMLCTGNSSHSSWDNQCQCTSSATRNTT KQVTPQPEEQKERKTTEMQSPMQPVDQASLPGHCREPPPWENEATERIYHFVVGQMVYY QCVQGYRALHRGPAESVCKMTHGKTRWTQPQLICTGGGGSGGGGSGGGGSGGGGSGG GGSGGGGSGGGGSGGGGSAPTSSSTKKTQLQLEHLLLDLQMILNGINNYKNPKLTRMLTF KFYMPKKATELKHLQCLEEELKPLEEVLNLAQSKNFHFDPRDVVSNINVFVLELKGSETT FMCEYADETATIVEFLNRWITFAQSIISTLT |
| 580 | APTSSSTKKTQLQLEHLLLDLQMILNGINNYKNPKLTRMLTFKFYMPKKATELKHLQCLE EELKPLEEVLNLAQSKNFHLRPRDLISNINVIVLELKGSETTFMCEYADETATIVEFLNRWI TFAQSIISTLTGGGGSGGGGSELCDDDPPEIPHATFKAMAYKEGTMLNCECKRGFRRIKSG SLYMLCTGNSSHSSWDNQCQCTSSATRNTTKQVTPQPEEQKERKTTEMQSPMQPVDQAS LPGHCREPPPWENEATERIYHFVVGQMVYYQCVQGYRALHRGPAESVCKMTHGKTRWT QPQLICTDKTHTCPPCPAPELLGGPSVFLFPPKPKDTLMISRTPEVTCVVVDVSHEDPEVKF NWYVDGVEVHNAKTKPREEQYASTYRVVSVLTVLHQDWLNGKEYKCKVSNKALPAPIE KTISKAKGQPREPQVYTLPPSRDELTKNQVSLTCLVKGFYPSDIAVEWESNGQPENNYKT TPPVLDSDGSFFLYSKLTVDKSRWQQGNVFSCSVMHEALHNHYTQKSLSLSPG |
| 581 | APTSSSTKKTQLQLEHLLLDLQMILNGINNYKNPKLTRMLTFKFYMPKKATELKHLQCLE EELKPLEEVLNLAQSKNFHLRPRDLISNINVIVLELKGSETTFMCEYADETATIVEFLNRWI TFAQSIISTLTGGGGSGGGGSGGGGSGGGGSELCDDDPPEIPHATFKAMAYKEGTMLNCE CKRGFRRIKSGSLYMLCTGNSSHSSWDNQCQCTSSATRNTTKQVTPQPEEQKERKTTEM QSPMQPVDQASLPGHCREPPPWENEATERIYHFVVGQMVYYQCVQGYRALHRGPAESV CKMTHGKTRWTQPQLICTDKTHTCPPCPAPELLGGPSVFLFPPKPKDTLMISRTPEVTCVV VDVSHEDPEVKFNWYVDGVEVHNAKTKPREEQYASTYRVVSVLTVLHQDWLNGKEYK CKVSNKALPAPIEKTISKAKGQPREPQVYTLPPSRDELTKNQVSLTCLVKGFYPSDIAVEW ESNGQPENNYKTTPPVLDSDGSFFLYSKLTVDKSRWQQGNVFSCSVMHEALHNHYTQKS LSLSPG |
| 582 | APTSSSTKKTQLQLEHLLLDLQMILNGINNYKNPKLTRMLTFKFYMPKKATELKHLQCLE EELKPLEEVLNLAQSKNFHFDPRDVVSNINVFVLELKGSETTFMCEYADETATIVEFLNR WITFAQSIISTLTGGGGSGGGGSGGGGSELCDDDPPEIPHATFKAMAYKEGTMLNCECKR GFRRIKSGSLYMLCTGNSSHSSWDNQCQCTSSATRNTTKQVTPQPEEQKERKTTEMQSP MQPVDQASLPGHCREPPPWENEATERIYHFVVGQMVYYQCVQGYRALHRGPAESVCKM THGKTRWTQPQLICTDKTHTCPPCPAPELLGGPSVFLFPPKPKDTLMISRTPEVTCVVVDV |

IX. SEQUENCES

| SEQ ID | AMINO ACID SEQUENCE |
|---|---|
| | SHEDPEVKFNWYVDGVEVHNAKTKPREEQYASTYRVVSVLTVLHQDWLNGKEYKCKV<br>SNKALPAPIEKTISKAKGQPREPQVYTLPPSRDELTKNQVSLTCLVKGFYPSDIAVEWESN<br>GQPENNYKTTPPVLDSDGSFFLYSKLTVDKSRWQQGNVFSCSVMHEALHNHYTQKSLSL<br>SPG |
| 583 | APTSSSTKKTQLQLEHLLLDLQMILNGINNYKNPKLTRMLTFKFYMPKKATELKHLQCLE<br>EELKPLEEVLNLAQSKNFHFDPRDVVSNINVFVLELKGSETTFMCEYADETATIVEFLNR<br>WITFAQSIISTLTGGGGSGGGGSELCDDDPPEIPHATFKAMAYKEGTMLNCECKRGFRRIK<br>SGSLYMLCTGNSSHSSWDNQCQCTSSATRNTTKQVTPQPEEQKERKTTEMQSPMQPVDQ<br>ASLPGHCREPPPWENEATERIYHFVVGQMVYYQCVQGYRALHRGPAESVCKMTHGKTR<br>WTQPQLICTDKTHTCPPCPAPELLGGPSVFLFPPKPKDTLMISRTPEVTCVVVDVSHEDPE<br>VKFNWYVDGVEVHNAKTKPREEQYASTYRVVSVLTVLHQDWLNGKEYKCKVSNKALP<br>APIEKTISKAKGQPREPQVYTLPPSRDELTKNQVSLTCLVKGFYPSDIAVEWESNGQPENN<br>YKTTPPVLDSDGSFFLYSKLTVDKSRWQQGNVFSCSVMHEALHNHYTQKSLSLSPG |
| 584 | APTSSSTKKTQLQLEHLLLDLQMILNGINNYKNPKLTRMLTFKFYMPKKATELKHLQCLE<br>EELKPLEEVLNLAQSKNFHFDPRDVVSNINVFVLELKGSETTFMCEYADETATIVEFLNR<br>WITFAQSIISTLTGGGGSGGGGSGGGGSGGGGSELCDDDPPEIPHATFKAMAYKEGTMLN<br>CECKRGFRRIKSGSLYMLCTGNSSHSSWDNQCQCTSSATRNTTKQVTPQPEEQKERKTTE<br>MQSPMQPVDQASLPGHCREPPPWENEATERIYHFVVGQMVYYQCVQGYRALHRGPAES<br>VCKMTHGKTRWTQPQLICTDKTHTCPPCPAPELLGGPSVFLFPPKPKDTLMISRTPEVTCV<br>VVDVSHEDPEVKFNWYVDGVEVHNAKTKPREEQYASTYRVVSVLTVLHQDWLNGKEY<br>KCKVSNKALPAPIEKTISKAKGQPREPQVYTLPPSRDELTKNQVSLTCLVKGFYPSDIAVE<br>WESNGQPENNYKTTPPVLDSDGSFFLYSKLTVDKSRWQQGNVFSCSVMHEALHNHYTQ<br>KSLSLSPG |
| 585 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNPHLRPRDLISNINVIVLELKGSETTFMCEYADETATIVEFLNRWITFAQSIISTLTGSS<br>GGPPGGMPYDLYHPSGGGAVNGTSQFTCFYNSRANISCVWSQDGALQDTSCQVHAWPD<br>RRRWNQTCELLPVSQASWACNLILGAPDSQKLTTVDIVTLRVLCREGVRWRVMAIQDFK<br>PFENLRLMAPISLQVVHVETHRCNISWEISQASHYFERHLEFEARTLSPGHTWEEAPLLTL<br>KQKQEWICLETLTPDTQYEFQVRVKPLQ |
| 586 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNPHLRPRDLISNINVIVLELKGSETTFMCEYADETATIVEFLNRWITFAQSIISTLTSGSP<br>SGSGGGMPYDLYHPSGGGAVNGTSQFTCFYNSRANISCVWSQDGALQDTSCQVHAWPD<br>RRRWNQTCELLPVSQASWACNLILGAPDSQKLTTVDIVTLRVLCREGVRWRVMAIQDFK<br>PFENLRLMAPISLQVVHVETHRCNISWEISQASHYFERHLEFEARTLSPGHTWEEAPLLTL<br>KQKQEWICLETLTPDTQYEFQVRVKPLQ |
| 587 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNPHLRPRDLISNINVIVLELKGSETTFMCEYADETATIVEFLNRWITFAQSIISTLTGPP<br>GPPGSSGMPYDLYHPSGGGAVNGTSQFTCFYNSRANISCVWSQDGALQDTSCQVHAWP<br>DRRRWNQTCELLPVSQASWACNLILGAPDSQKLTTVDIVTLRVLCREGVRWRVMAIQDF<br>KPFENLRLMAPISLQVVHVETHRCNISWEISQASHYFERHLEFEARTLSPGHTWEEAPLLT<br>LKQKQEWICLETLTPDTQYEFQVRVKPLQ |
| 588 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNPHLRPRDLISNINVIVLELKGSETTFMCEYADETATIVEFLNRWITFAQSIISTLTGSSS<br>GPPGPPSMPYDLYHPSGGGAVNGTSQFTCFYNSRANISCVWSQDGALQDTSCQVHAWPD<br>RRRWNQTCELLPVSQASWACNLILGAPDSQKLTTVDIVTLRVLCREGVRWRVMAIQDFK<br>PFENLRLMAPISLQVVHVETHRCNISWEISQASHYFERHLEFEARTLSPGHTWEEAPLLTL<br>KQKQEWICLETLTPDTQYEFQVRVKPLQ |
| 589 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ |

| SEQ ID | AMINO ACID SEQUENCE |
|---|---|
| | LEHLLLDLQMILNGINNYKNPKLTAMLTAKFAMPKKATELKHLQCLEEALKPLEEVLNL
AQSKNFHLRPRDLISNINVIVLELKGSETTFMCEYADETATIVEFLNRWITFAQSIISTLTGS
SGGPPGGMPYDLYHPSGGGAVNGTSQFTCFYNSRANISCVWSQDGALQDTSCQVHAWP
DRRRWNQTCELLPVSQASWACNLILGAPDSQKLTTVDIVTLRVLCREGVRWRVMAIQDF
KPFENLRLMAPISLQVVHVETHRCNISWEISQASHYFERHLEFEARTLSPGHTWEEAPLLT
LKQKQEWICLETLTPDTQYEFQVRVKPLQ |
| 590 | DKTHTCPPCPAPELLGGPSVFLFPPKPKDTLMISRTPEVTCVVVDVSHEDPEVKFNWYVD
GVEVHNAKTKPREEQYASTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGAPTSSSTKKTQLQ
LEHLLLDLQMILNGINNYKNPKLTAMLTAKFAMPKKATELKHLQCLEEALKPLEEVLNL
AQSKNFHLRPRDLISNINVIVLELKGSETTFMCEYADETATIVEFLNRWITFAQSIISTLTSG
SPSGSGGGMPYDLYHPSGGGAVNGTSQFTCFYNSRANISCVWSQDGALQDTSCQVHAW
PDRRRWNQTCELLPVSQASWACNLILGAPDSQKLTTVDIVTLRVLCREGVRWRVMAIQD
FKPFENLRLMAPISLQVVHVETHRCNISWEISQASHYFERHLEFEARTLSPGHTWEEAPLL
TLKQKQEWICLETLTPDTQYEFQVRVKPLQ |
| 591 | DKTHTCPPCPAPELLGGPSVFLFPPKPKDTLMISRTPEVTCVVVDVSHEDPEVKFNWYVD
GVEVHNAKTKPREEQYASTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGAPTSSSTKKTQLQ
LEHLLLDLQMILNGINNYKNPKLTAMLTAKFAMPKKATELKHLQCLEEALKPLEEVLNL
AQSKNFHLRPRDLISNINVIVLELKGSETTFMCEYADETATIVEFLNRWITFAQSIISTLTGP
PGPPGSSGMPYDLYHPSGGGAVNGTSQFTCFYNSRANISCVWSQDGALQDTSCQVHAWP
DRRRWNQTCELLPVSQASWACNLILGAPDSQKLTTVDIVTLRVLCREGVRWRVMAIQDF
KPFENLRLMAPISLQVVHVETHRCNISWEISQASHYFERHLEFEARTLSPGHTWEEAPLLT
LKQKQEWICLETLTPDTQYEFQVRVKPLQ |
| 592 | DKTHTCPPCPAPELLGGPSVFLFPPKPKDTLMISRTPEVTCVVVDVSHEDPEVKFNWYVD
GVEVHNAKTKPREEQYASTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGAPTSSSTKKTQLQ
LEHLLLDLQMILNGINNYKNPKLTAMLTAKFAMPKKATELKHLQCLEEALKPLEEVLNL
AQSKNFHLRPRDLISNINVIVLELKGSETTFMCEYADETATIVEFLNRWITFAQSIISTLTGS
SSGPPGPPSMPYDLYHPSGGGAVNGTSQFTCFYNSRANISCVWSQDGALQDTSCQVHAW
PDRRRWNQTCELLPVSQASWACNLILGAPDSQKLTTVDIVTLRVLCREGVRWRVMAIQD
FKPFENLRLMAPISLQVVHVETHRCNISWEISQASHYFERHLEFEARTLSPGHTWEEAPLL
TLKQKQEWICLETLTPDTQYEFQVRVKPLQ |
| 593 | DKTHTCPPCPAPELLGGPSVFLFPPKPKDTLMISRTPEVTCVVVDVSHEDPEVKFNWYVD
GVEVHNAKTKPREEQYASTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGAPTSSSTKKTQLQ
LEHLLLDLQMILNGINNYKNPKLTAMLTAKFAMPKKATELKHLQCLEEALKPLEEVLNL
AQSKNFHFDPRDVVSNINVFVLELKGSETTFMCEYADETATIVEFLNRWITFAQSIISTLTG
PPSGSSPMPYDLYHPSGGGAVNGTSQFTCFYNSRANISCVWSQDGALQDTSCQVHAWPD
RRRWNQTCELLPVSQASWACNLILGAPDSQKLTTVDIVTLRVLCREGVRWRVMAIQDFK
PFENLRLMAPISLQVVHVETHRCNISWEISQASHYFERHLEFEARTLSPGHTWEEAPLLTL
KQKQEWICLETLTPDTQYEFQVRVKPLQ |
| 594 | DKTHTCPPCPAPELLGGPSVFLFPPKPKDTLMISRTPEVTCVVVDVSHEDPEVKFNWYVD
GVEVHNAKTKPREEQYASTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGAPTSSSTKKTQLQ
LEHLLLDLQMILNGINNYKNPKLTAMLTAKFAMPKKATELKHLQCLEEALKPLEEVLNL
AQSKNFHFDPRDVVSNINVFVLELKGSETTFMCEYADETATIVEFLNRWITFAQSIISTLTG
SSGGPPGGMPYDLYHPSGGGAVNGTSQFTCFYNSRANISCVWSQDGALQDTSCQVHAW
PDRRRWNQTCELLPVSQASWACNLILGAPDSQKLTTVDIVTLRVLCREGVRWRVMAIQD
FKPFENLRLMAPISLQVVHVETHRCNISWEISQASHYFERHLEFEARTLSPGHTWEEAPLL
TLKQKQEWICLETLTPDTQYEFQVRVKPLQ |
| 595 | DKTHTCPPCPAPELLGGPSVFLFPPKPKDTLMISRTPEVTCVVVDVSHEDPEVKFNWYVD
GVEVHNAKTKPREEQYASTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGAPTSSSTKKTQLQ
LEHLLLDLQMILNGINNYKNPKLTAMLTAKFAMPKKATELKHLQCLEEALKPLEEVLNL
AQSKNFHFDPRDVVSNINVFVLELKGSETTFMCEYADETATIVEFLNRWITFAQSIISTLTS
GSPSGSGGGMPYDLYHPSGGGAVNGTSQFTCFYNSRANISCVWSQDGALQDTSCQVHA
WPDRRRWNQTCELLPVSQASWACNLILGAPDSQKLTTVDIVTLRVLCREGVRWRVMAIQ
DFKPFENLRLMAPISLQVVHVETHRCNISWEISQASHYFERHLEFEARTLSPGHTWEEAPL
LTLKQKQEWICLETLTPDTQYEFQVRVKPLQ |

IX. SEQUENCES

| SEQ ID | AMINO ACID SEQUENCE |
|---|---|
| 596 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTAMLTAKFAMPKKATELKHLQCLEEALKPLEEVLNL<br>AQSKNFHFDPRDVVSNINVFVLELKGSETTFMCEYADETATIVEFLNRWITFAQSIISTLTG<br>PPGPPPGSSGMPYDLYHPSGGGAVNGTSQFTCFYNSRANISCVWSQDGALQDTSCQVHAW<br>PDRRRWNQTCELLPVSQASWACNLILGAPDSQKLTTVDIVTLRVLCREGVRWRVMAIQD<br>FKPFENLRLMAPISLQVVHVETHRCNISWEISQASHYFERHLEFEARTLSPGHTWEEAPLL<br>TLKQKQEWICLETLTPDTQYEFQVRVKPLQ |
| 597 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTAMLTAKFAMPKKATELKHLQCLEEALKPLEEVLNL<br>AQSKNFHFDPRDVVSNINVFVLELKGSETTFMCEYADETATIVEFLNRWITFAQSIISTLTG<br>SSSGPPGPPSMPYDLYHPSGGGAVNGTSQFTCFYNSRANISCVWSQDGALQDTSCQVHA<br>WPDRRRWNQTCELLPVSQASWACNLILGAPDSQKLTTVDIVTLRVLCREGVRWRVMAIQ<br>DFKPFENLRLMAPISLQVVHVETHRCNISWEISQASHYFERHLEFEARTLSPGHTWEEAPL<br>LTLKQKQEWICLETLTPDTQYEFQVRVKPLQ |
| 598 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGPAELCDDDPPEIP<br>HATFKAMAYKEGTMLNCECKRGFRRIKSGSLYMLCTGNSSHSSWDNQCQCTSSATRNTT<br>KQVTPQPEEQKERKTTEMQSPMQPVDQASLPGHCREPPPWENEATERIYHFVVGQMVYY<br>QCVQGYRALHRGPAESVCKMTHGKTRWTQPQLICTGGGGGGGGGGGGGGGGGGGG<br>GGGGGGGGGGGGGGAPTSSSTKKTQLQLEHLLLDLQMILNGINNYKNPKLTRMLTFKFY<br>MPKKATELKHLQCLEEELKPLEEVLNLAQSKNFHLRPRDLISNINVIVLELKGSETTFMCE<br>YADETATIVEFLNRWITFAQSIISTLTGSSSGPPGGMPYDLYHPSGGGAVNGTSQFTCFYN<br>SRANISCVWSQDGALQDTSCQVHAWPDRRRWNQTCELLPVSQASWACNLILGAPDSQK<br>LTTVDIVTLRVLCREGVRWRVMAIQDFKPFENLRLMAPISLQVVHVETHRCNISWEISQA<br>SHYFERHLEFEARTLSPGHTWEEAPLLTLKQKQEWICLETLTPDTQYEFQVRVKPLQ |
| 599 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGPAELCDDDPPEIP<br>HATFKAMAYKEGTMLNCECKRGFRRIKSGSLYMLCTGNSSHSSWDNQCQCTSSATRNTT<br>KQVTPQPEEQKERKTTEMQSPMQPVDQASLPGHCREPPPWENEATERIYHFVVGQMVYY<br>QCVQGYRALHRGPAESVCKMTHGKTRWTQPQLICTGGGGGGGGGGGGGGGGGGGG<br>GGGGGGGGGGGGGGAPTSSSTKKTQLQLEHLLLDLQMILNGINNYKNPKLTRMLTFKFY<br>MPKKATELKHLQCLEEELKPLEEVLNLAQSKNFHLRPRDLISNINVIVLELKGSETTFMCE<br>YADETATIVEFLNRWITFAQSIISTLTSGSPSGGGGMPYDLYHPSGGGAVNGTSQFTCFY<br>NSRANISCVWSQDGALQDTSCQVHAWPDRRRWNQTCELLPVSQASWACNLILGAPDSQ<br>KLTTVDIVTLRVLCREGVRWRVMAIQDFKPFENLRLMAPISLQVVHVETHRCNISWEISQ<br>ASHYFERHLEFEARTLSPGHTWEEAPLLTLKQKQEWICLETLTPDTQYEFQVRVKPLQ |
| 600 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGPAELCDDDPPEIP<br>HATFKAMAYKEGTMLNCECKRGFRRIKSGSLYMLCTGNSSHSSWDNQCQCTSSATRNTT<br>KQVTPQPEEQKERKTTEMQSPMQPVDQASLPGHCREPPPWENEATERIYHFVVGQMVYY<br>QCVQGYRALHRGPAESVCKMTHGKTRWTQPQLICTGGGGGGGGGGGGGGGGGGGG<br>GGGGGGGGGGGGGGAPTSSSTKKTQLQLEHLLLDLQMILNGINNYKNPKLTRMLTFKFY<br>MPKKATELKHLQCLEEELKPLEEVLNLAQSKNFHLRPRDLISNINVIVLELKGSETTFMCE<br>YADETATIVEFLNRWITFAQSIISTLTGPPGPPGSSGMPYDLYHPSGGGAVNGTSQFTCFYN<br>SRANISCVWSQDGALQDTSCQVHAWPDRRRWNQTCELLPVSQASWACNLILGAPDSQK<br>LTTVDIVTLRVLCREGVRWRVMAIQDFKPFENLRLMAPISLQVVHVETHRCNISWEISQA<br>SHYFERHLEFEARTLSPGHTWEEAPLLTLKQKQEWICLETLTPDTQYEFQVRVKPLQ |
| 601 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGPAELCDDDPPEIP<br>HATFKAMAYKEGTMLNCECKRGFRRIKSGSLYMLCTGNSSHSSWDNQCQCTSSATRNTT<br>KQVTPQPEEQKERKTTEMQSPMQPVDQASLPGHCREPPPWENEATERIYHFVVGQMVYY<br>QCVQGYRALHRGPAESVCKMTHGKTRWTQPQLICTGGGGGGGGGGGGGGGGGGGG<br>GGGGGGGGGGGGGGAPTSSSTKKTQLQLEHLLLDLQMILNGINNYKNPKLTRMLTFKFY<br>MPKKATELKHLQCLEEELKPLEEVLNLAQSKNFHLRPRDLISNINVIVLELKGSETTFMCE |

| IX. SEQUENCES | |
|---|---|
| SEQ ID | AMINO ACID SEQUENCE |
| | YADETATIVEFLNRWITFAQSIISTLTGSSSGPPGPPSMPYDLYHPSGGGAVNGTSQFTCFY NSRANISCVWSQDGALQDTSCQVHAWPDRRRWNQTCELLPVSQASWACNLILGAPDSQ KLTTVDIVTLRVLCREGVRWRVMAIQDFKPFENLRLMAPISLQVVHVETHRCNISWEISQ ASHYFERHLEFEARTLSPGHTWEEAPLLTLKQKQEWICLETLTPDTQYEFQVRVKPLQ |
| 602 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAPTSSSTKKTQLQ LEHLLLDLQMILNGINNYKNPKLTRMLTFKFYMPKKATELKHLQCLEEELKPLEEVLNLA QSKNFHLRPRDLISNINVIVLELKGSETTFMCEYADETATIVEFLNRWITFAQSIISTLTGPPS GSSPMPYDLYHPSGGGAVNGTSQFTCFYNSRANISCVWSQDGALQDTSCQVHAWPDRR RWNQTCELLPVSQASWACNLILGAPDSQKLTTVDIVTLRVLCREGVRWRVMAIQDFKPF ENLRLMAPISLQVVHVETHRCNISWEISQASHYFERHLEFEARTLSPGHTWEEAPLLTLKQ KQEWICLETLTPDTQYEFQVRVKPLQGEFTTWSPWSQPLAFRTKPAALGKD |
| 603 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPGPGSGAVNGTSQF TCFYNSRANISCVWSQDGALQDTSCQVHAWPDRRRWNQTCELLPVSQASWACNLILGA PDSQKLTTVDIVTLRVLCREGVRWRVMAIQDFKPFENLRLMAPISLQVVHVETHRCNISW EISQASHYFERHLEFEARTLSPGHTWEEAPLLTLKQKQEWICLETLTPDTQYEFQVRVKPL Q |
| 604 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPMPYDLYHP APTSSSTKKTQLQLEHLLLDLQMILNGINNYKNPKLTRMLTFKFYMPKKATELKHLQCLE EELKPLEEVLNLAQSKNFHLRPRDLISNINVIVLELKGSETTFMCEYADETATIVEFLNRWI TFAQSIISTLT |
| 605 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPPMPYDLYH PSGPAPTSSSTKKTQLQLEHLLLDLQMILNGINNYKNPKLTRMLTFKFYMPKKATELKHL QCLEEELKPLEEVLNLAQSKNFHLRPRDLISNINVIVLELKGSETTFMCEYADETATIVEFL NRWITFAQSIISTLT |
| 606 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPSMPYDLYH PSGPAPTSSSTKKTQLQLEHLLLDLQMILNGINNYKNPKLTRMLTFKFYMPKKATELKHL QCLEEELKPLEEVLNLAQSKNFHLRPRDLISNINVIVLELKGSETTFMCEYADETATIVEFL NRWITFAQSIISTLT |
| 607 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAPTSSSTKKTQLQ LEHLLLDLQMILNGINNYKNPKLTRMLTFKFYMPKKATELKHLQCLEEELKPLEEVLNLA QSKNFHFDPRDVVSNINVFVLELKGSETTFMCEYADETATIVEFLNRWITFAQSIISTLT |
| 608 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTRMLTFKFYMPKKATELK HLQCLEEELKPLEEVLNLAQSKNFHLRPRDLISNINVIVLELKGSETTFMCEYADETATIVE FLNRWITFAQSIISTLT |
| 609 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPGPGSGAVNGTSQ FTCFYNSRANISCVWSQDGALQDTSCQVHAWPDRRRWNQTCELLPVSQASWACNLILG APDSQKLTTVDIVTLRVLCREGVRWRVMAIQDFKPFENLRLMAPISLQVVHVETHRCNIS WEISQASHYFERHLEFEARTLSPGHTWEEAPLLTLKQKQEWICLETLTPDTQYEFQVRVK PLQ |

IX. SEQUENCES

| SEQ ID | AMINO ACID SEQUENCE |
|---|---|
| 610 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAPTSSSTKKTQLQ LEHLLLDLQMILNGINNYKNPKLTRMLTFKFYMPKKATELKHLQCLEEELKPLEEVLNLA QSKNFHLRPRDLISNINVIVLELKGSETTFMCEYADETATIVEFLNRWITFAQSIISTLTGPPS GSSPMPYDLYHPSGGGAVNGTSQFTCFYNSRANISCVWSQDGALQDTSCQVHAWPDRR RWNQTCELLPVSQASWACNLILGAPDSQKLTTVDIVTLRVLCREGVRWRVMAIQDF |
| 611 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAPTSSSTKKTQLQ LEHLLLDLQMILNGINNYKNPKLTRMLTFKFYMPKKATELKHLQCLEEELKPLEEVLNLA QSKNFHLRPRDLISNINVIVLELKGSETTFMCEYADETATIVEFLNRWITFAQSIISTLTGSS GGPPGGMPYDLYHPSGGGAVNGTSQFTCFYNSRANISCVWSQDGALQDTSCQVHAWPD RRRWNQTCELLPVSQASWACNLILGAPDSQKLTTVDIVTLRVLCREGVRWRVMAIQDF |
| 612 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAPTSSSTKKTQLQ LEHLLLDLQMILNGINNYKNPKLTRMLTFKFYMPKKATELKHLQCLEEELKPLEEVLNLA QSKNFHLRPRDLISNINVIVLELKGSETTFMCEYADETATIVEFLNRWITFAQSIISTLTSGSP SGSGGGMPYDLYHPSGGGAVNGTSQFTCFYNSRANISCVWSQDGALQDTSCQVHAWPD RRRWNQTCELLPVSQASWACNLILGAPDSQKLTTVDIVTLRVLCREGVRWRVMAIQDF |
| 613 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAPTSSSTKKTQLQ LEHLLLDLQMILNGINNYKNPKLTRMLTFKFYMPKKATELKHLQCLEEELKPLEEVLNLA QSKNFHLRPRDLISNINVIVLELKGSETTFMCEYADETATIVEFLNRWITFAQSIISTLTGPP GPPGSSGMPYDLYHPSGGGAVNGTSQFTCFYNSRANISCVWSQDGALQDTSCQVHAWP DRRRWNQTCELLPVSQASWACNLILGAPDSQKLTTVDIVTLRVLCREGVRWRVMAIQDF |
| 614 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPSRDELTKNQVSLTCLVKGFYPSDIAVEWESNGQPENNYKTTPPVLD SDGSFFLYSKLTVDKSRWQQGNVFSCSVMHEALHNHYTQKSLSLSPGAPTSSSTKKTQLQ LEHLLLDLQMILNGINNYKNPKLTRMLTFKFYMPKKATELKHLQCLEEELKPLEEVLNLA QSKNFHLRPRDLISNINVIVLELKGSETTFMCEYADETATIVEFLNRWITFAQSIISTLTGSSS GPPGPPSMPYDLYHPSGGGAVNGTSQFTCFYNSRANISCVWSQDGALQDTSCQVHAWPD RRRWNQTCELLPVSQASWACNLILGAPDSQKLTTVDIVTLRVLCREGVRWRVMAIQDF |
| 615 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPGAPTSSSTKKTQLQ LEHLLLDLQMILNGINNYKNPKLTRMLTFKFYMPKKATELKHLQCLEEELKPLEEVLNLA QSKNFHLRPRDLISNINVIVLELKGSETTFMCEYADETATIVEFLNRWITFAQSIISTLT |
| 616 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGK |
| 617 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGPPSGSSPMPY DLYHPSGGGAVNGTSQFTCFYNSRANISCVWSQDGALQDTSCQVHAWPDRRRWNQTCE LLPVSQASWACNLILGAPDSQKLTTVDIVTLRVLCREGVRWRVMAIQDFKPFENLRLMAP ISLQVVHVETHRCNISWEISQASHYFERHLEFEARTLSPGHTWEEAPLLTLKQKQEWICLE TLTPDTQYEFQVRVKPLQ |
| 618 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLTCLVEGFYPSDIAVEWESNGQPENNYKTTPPVLD SDGSFFLYSKLTVDKSRWQQGNVFSCSVMHEALHNHYTQESLSLSPGAPTSSSTKKTQLQ LEHLLLDLQMILNGINNYKNPKLTRMLTFKFYMPKKATELKHLQCLEEELKPLEEVLNLA QSKNFHLRPRDLISNINVIVLELKGSETTFMCEYADETATIVEFLNRWITFAQSIISTLT |

IX. SEQUENCES

| SEQ ID | AMINO ACID SEQUENCE |
|---|---|
| 619 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLTCLVKGFYPSDIAVEWESNGQPENNYKTTPPVLD<br>SDGSFFLYSKLTVDKSRWQQGNVFSCSVMHEALHNHYTQKSLSLSPGK |
| 620 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLTCLVKGFYPSDIAVEWESNGQPENNYKTTPPVLD<br>SDGSFFLYSKLTVDKSRWQQGNVFSCSVMHEALHNHYTQKSLSLSPGGPPSGSSPMPYDL<br>YHPSGGGAVNGTSQFTCFYNSRANISCVWSQDGALQDTSCQVHAWPDRRRWNQTCELL<br>PVSQASWACNLILGAPDSQKLTTVDIVTLRVLCREGVRWRVMAIQDFKPFENLRLMAPIS<br>LQVVHVETHRCNISWEISQASHYFERHLEFEARTLSPGHTWEEAPLLTLKQKQEWICLETL<br>TPDTQYEFQVRVKPLQ |
| 621 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVKGFYPSDIAVEWESNGQPENNYDTTPPVLD<br>SDGSFFLVSDLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLT |
| 622 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKELTKNQVSLWCLVKGFYPSDIAVEWESNGQPENNYKTTPPVL<br>KSDGSFFLYSKLTVDKSRWQQGNVFSCSVMHEALHNHYTQKSLSLSPGK |
| 623 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKELTKNQVSLWCLVKGFYPSDIAVEWESNGQPENNYKTTPPVL<br>KSDGSFFLYSKLTVDKSRWQQGNVFSCSVMHEALHNHYTQKSLSLSPGGPPSGSSPMPY<br>DLYHPSGGGAVNGTSQFTCFYNSRANISCVWSQDGALQDTSCQVHAWPDRRRWNQTCE<br>LLPVSQASWACNLILGAPDSQKLTTVDIVTLRVLCREGVRWRVMAIQDFKPFENLRLMAP<br>ISLQVVHVETHRCNISWEISQASHYFERHLEFEARTLSPGHTWEEAPLLTLKQKQEWICLE<br>TLTPDTQYEFQVRVKPLQ |
| 624 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVEGFYPSDIAVEWESNGQPENNYKTTPPVLD<br>SDGSFFLVSKLTVDKSRWQQGNVFSCSVMHEALHNHYTQESLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLT |
| 625 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLWCLVKGFYPSDIAVEWESNGQPENNYKTTPPVL<br>DSDGSFFLYSKLTVDKSRWQQGNVFSCSVMHEALHNHYTQKSLSLSPGK |
| 626 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLWCLVKGFYPSDIAVEWESNGQPENNYKTTPPVL<br>DSDGSFFLYSKLTVDKSRWQQGNVFSCSVMHEALHNHYTQKSLSLSPGGPPSGSSPMPY<br>DLYHPSGGGAVNGTSQFTCFYNSRANISCVWSQDGALQDTSCQVHAWPDRRRWNQTCE<br>LLPVSQASWACNLILGAPDSQKLTTVDIVTLRVLCREGVRWRVMAIQDFKPFENLRLMAP<br>ISLQVVHVETHRCNISWEISQASHYFERHLEFEARTLSPGHTWEEAPLLTLKQKQEWICLE<br>TLTPDTQYEFQVRVKPLQ |
| 627 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLTPGP<br>GPMPYDLYHPSGGCGGHQYERRGGC |
| 628 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLTPGP<br>GPMPYDLYHPSGGCSGHQYERREGC |
| 629 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA |

| IX. SEQUENCES | |
| --- | --- |
| SEQ ID | AMINO ACID SEQUENCE |
| | KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLTPGP<br>GPMPYDLYHPSGGCGGHYFERHGGC |
| 630 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLTPGP<br>GPMPYDLYHPSGGCSGHYFERHEGC |
| 631 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLTPGP<br>GPMPYDLYHPSGGCSFHQYERHEGC |
| 632 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLTPSGS<br>SMPYDLYHPSGGCGGHQYERRGGC |
| 633 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLTPSGS<br>SMPYDLYHPSGGCSGHQYERREGC |
| 634 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLTPSGS<br>SMPYDLYHPSGGCGGHYFERHGGC |
| 635 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLTPSGS<br>SMPYDLYHPSGGCSGHYFERHEGC |
| 636 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLTPSGS<br>SMPYDLYHPSGGCSFHQYERHEGC |
| 637 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGPGSGSAVNGTSQ<br>FTCFYNSRANISCVWSQDGALQDTSCQVHAWPDRRRWNQTCELLPVSQASWACNLILG<br>APDSQKLTTVDIVTLRVLCREGVRWRVMAIQDFKPFENLRLMAPISLQVVHVETHRCNIS<br>WEISQASHYFERHLEFEARTLSPGHTWEEAPLLTLKQKQEWICLETLTPDTQYEFQVRVK<br>PLQGEFTTWSPWSQPLAFRTKPAALGKD |
| 638 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL |

IX. SEQUENCES

| SEQ ID | AMINO ACID SEQUENCE |
|---|---|
| | DSDGSFFLYSKLTVDKSRWQQGNVFSCSVMHEALHNHYTQKSLSLSPGGPPSGSSPMPY<br>DLYHPSGGGAVNGTSQFTCFYNSRANISCVWSQDGALQDTSCQVHAWPDRRRWNQTCE<br>LLPVSQASWACNLILGAPDSQKLTTVDIVTLRVLCREGVRWRVMAIQDFKPFENLRLMAP<br>ISLQVVHVETHRCNISWEISQASHYFERHLEFEARTLSPGHTWEEAPLLTLKQKQEWICLE<br>TLTPDTQYEFQVRVKPLQGEFTTWSPWSQPLAFRTKPAALGKD |
| 639 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLTCLVKGFYPSDIAVEWESNGQPENNYKTTPPVLD<br>SDGSFFLYSKLTVDKSRWQQGNVFSCSVMHEALHNHYTQKSLSLSPGGPPSGSSPMPYDL<br>YHPSGGGAVNGTSQFTCFYNSRANISCVWSQDGALQDTSCQVHAWPDRRRWNQTCELL<br>PVSQASWACNLILGAPDSQKLTTVDIVTLRVLCREGVRWRVMAIQDFKPFENLRLMAPIS<br>LQVVHVETHRCNISWEISQASHYFERHLEFEARTLSPGHTWEEAPLLTLKQKQEWICLETL<br>TPDTQYEFQVRVKPLQGEFTTWSPWSQPLAFRTKPAALGKD |
| 640 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKELTKNQVSLWCLVKGFYPSDIAVEWESNGQPENNYKTTPPVL<br>KSDGSFFLYSKLTVDKSRWQQGNVFSCSVMHEALHNHYTQKSLSLSPGGPPSGSSPMPY<br>DLYHPSGGGAVNGTSQFTCFYNSRANISCVWSQDGALQDTSCQVHAWPDRRRWNQTCE<br>LLPVSQASWACNLILGAPDSQKLTTVDIVTLRVLCREGVRWRVMAIQDFKPFENLRLMAP<br>ISLQVVHVETHRCNISWEISQASHYFERHLEFEARTLSPGHTWEEAPLLTLKQKQEWICLE<br>TLTPDTQYEFQVRVKPLQGEFTTWSPWSQPLAFRTKPAALGKD |
| 641 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLWCLVKGFYPSDIAVEWESNGQPENNYKTTPPVL<br>DSDGSFFLYSKLTVDKSRWQQGNVFSCSVMHEALHNHYTQKSLSLSPGGPPSGSSPMPY<br>DLYHPSGGGAVNGTSQFTCFYNSRANISCVWSQDGALQDTSCQVHAWPDRRRWNQTCE<br>LLPVSQASWACNLILGAPDSQKLTTVDIVTLRVLCREGVRWRVMAIQDFKPFENLRLMAP<br>ISLQVVHVETHRCNISWEISQASHYFERHLEFEARTLSPGHTWEEAPLLTLKQKQEWICLE<br>TLTPDTQYEFQVRVKPLQGEFTTWSPWSQPLAFRTKPAALGKD |
| 642 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTAMLTAKFAMPKKATELKHLQCLEEALKPLEEVLNL<br>AQSKNFHLRPRDLISNINVIVLELKGSETTFMCEYADETATIVEFLNRWITFAQSIISTLTGP<br>PSGSSPMPYDLYHPSGGGAVNGTSQFTCFYNSRANISCVWSQDGALQDTSCQVHAWPDR<br>RRWNQTCELLPVSQASWACNLILGAPDSQKLTTVDIVTLRVLCREGVRWRVMAIQDFKP<br>FENLRLMAPISLQVVHVETHRCNISWEISQASHYFERHLEFEARTLSPGHTWEEAPLLTLK<br>QKQEWICLETLTPDTQYEFQVRVKPLQGEFTTWSPWSQPLAFRTKPAALGKD |
| 643 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLDLQMILNGINNYKNPKLTAMLTAKFAMPKKATELKHLQCLEEALKPLEEVLNL<br>AQSKNFHFDPRDVVSNINVFVLELKGSETTFMCEYADETATIVEFLNRWITFAQSIISTLTG<br>PPSGSSPMPYDLYHPSGGGAVNGTSQFTCFYNSRANISCVWSQDGALQDTSCQVHAWPD<br>RRRWNQTCELLPVSQASWACNLILGAPDSQKLTTVDIVTLRVLCREGVRWRVMAIQDFK<br>PFENLRLMAPISLQVVHVETHRCNISWEISQASHYFERHLEFEARTLSPGHTWEEAPLLTL<br>KQKQEWICLETLTPDTQYEFQVRVKPLQGEFTTWSPWSQPLAFRTKPAALGKD |
| 644 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVKGFYPSDIAVEWESNGQPENNYKTTPPVLD<br>SDGSFFLVSKLTVDKSRWQQGNVFSCSVMHEALHNHYTQKSLSLSPGPGSGSAVNGTSQ<br>FTCFYNSRANISCVWSQDGALQDTSCQVHAWPDRRRWNQTCELLPVSQASWACNLILG<br>APDSQKLTTVDIVTLRVLCREGVRWRVMAIQDFKPFENLRLMAPISLQVVHVETHRCNIS<br>WEISQASHYFERHLEFEARTLSPGHTWEEAPLLTLKQKQEWICLETLTPDTQYEFQVRVK<br>PLQ |
| 645 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEILCLLLQMILNGILNYKNPKLTRMLTFKFYMPKKATELKHLQCLEEELKPLEEVLNLAQ<br>SKNFHLRPRDLISNINVIVLELKGSETTFMCEYADETATIVEFLNRWITFCQSIISTLT |
| 646 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD |

IX. SEQUENCES

| SEQ ID | AMINO ACID SEQUENCE |
|---|---|
| | SDGSFFLYSKLTVDKSRWQQGNVFSCSVMHEALHNHYTQKSLSLSPGAPTSSSTKKTQLQ<br>LEILLLLLQMILNGILNYKNPKLTRMLTFKFYMPKKATELKHLQCLEEELKPLEEVLNLAQ<br>SKNFHLRPRDLISNINIVLELKGSETTFMCEYADETATIVEFLNRWITFIQSIISTLT |
| 647 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEILCLFLQMILNGILNYKNPKLTRMLTFKFYMPKKATELKHLQCLEEELKPLEEVLNLAQ<br>SKNFHLRPRDLISNINIVLELKGSETTFMCEYADETATIVEFLNRWITFCQSIISTLT |
| 648 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEILLLLFLQMILNGILNYKNPKLTRMLTFKFYMPKKATELKHLQCLEEELKPLEEVLNLAQ<br>SKNFHLRPRDLISNINIVLELKGSETTFMCEYADETATIVEFLNRWITFIQSIISTLT |
| 649 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLCLLLQMILNGILNYKNPKLTRMLTFKFYMPKKATELKHLQCLEEELKPLEEVLNLA<br>QSKNFHLRPRDLISNINIVLELKGSETTFMCEYADETATIVEFLNRWITFCQSIISTLT |
| 650 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLLLQMILNGILNYKNPKLTRMLTFKFYMPKKATELKHLQCLEEELKPLEEVLNLA<br>QSKNFHLRPRDLISNINIVLELKGSETTFMCEYADETATIVEFLNRWITFIQSIISTLT |
| 651 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEILLLLLQMILNGILNYKNPKLTRMLTFKFYMPKKATELKHLQCLEEELKPLEEVLNLAQ<br>SKNFHLRPRDLISNINIVLELKGSETTFMCEYADETATIVEFLNRWITFAQSIISTLT |
| 652 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEILLLFLQMILNGILNYKNPKLTRMLTFKFYMPKKATELKHLQCLEEELKPLEEVLNLAQ<br>SKNFHLRPRDLISNINIVLELKGSETTFMCEYADETATIVEFLNRWITFAQSIISTLT |
| 653 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLLLQMILNGILNYKNPKLTRMLTFKFYMPKKATELKHLQCLEEELKPLEEVLNLA<br>QSKNFHLRPRDLISNINIVLELKGSETTFMCEYADETATIVEFLNRWITFAQSIISTLT |
| 654 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLCLFLQMILNGILNYKNPKLTRMLTFKFYMPKKATELKHLQCLEEELKPLEEVLNLA<br>QSKNFHLRPRDLISNINIVLELKGSETTFMCEYADETATIVEFLNRWITFCQSIISTLT |
| 655 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLFLQMILNGILNYKNPKLTRMLTFKFYMPKKATELKHLQCLEEELKPLEEVLNLA<br>QSKNFHLRPRDLISNINIVLELKGSETTFMCEYADETATIVEFLNRWITFIQSIISTLT |
| 656 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEHLLLFLQMILNGILNYKNPKLTRMLTFKFYMPKKATELKHLQCLEEELKPLEEVLNLA<br>QSKNFHLRPRDLISNINIVLELKGSETTFMCEYADETATIVEFLNRWITFAQSIISTLT |

IX. SEQUENCES

| SEQ ID | AMINO ACID SEQUENCE |
|---|---|
| 657 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEILCLLLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFCQSIISTLT |
| 658 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEILLLLLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFIQSIISTLT |
| 659 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEILLLLLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFAQSIISTLT |
| 660 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEILCLFLQMILNGINNYKNPKLTRMLTFKFYMPKKATELKHLQCLEEELKPLEEVLNLA<br>QSKNFHLRPRDLISNINVIVLELKGSETTFMCEYADETATIVEFLNRWITFCQSIISTLT |
| 661 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEILLLFLQMILNGINNYKNPKLTRMLTFKFYMPKKATELKHLQCLEEELKPLEEVLNLAQ<br>SKNFHLRPRDLISNINVIVLELKGSETTFMCEYADETATIVEFLNRWITFIQSIISTLT |
| 662 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPSRDELTKNQVSLTCLVKGFYPSDIAVEWESNGQPENNYKTTPPVLD<br>SDGSFFLYSKLTVDKSRWQQGNVFSCSVMHEALHNHYTQKSLSLSPGAPTSSSTKKTQLQ<br>LEILLLFLQMILNGINNYKNPKLTRMLTFKFYMPKKATELKHLQCLEEELKPLEEVLNLAQ<br>SKNFHLRPRDLISNINVIVLELKGSETTFMCEYADETATIVEFLNRWITFAQSIISTLT |
| 663 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVKGFYPSDIAVEWESNGQPENNYDTTPPVLD<br>SDGSFFLVSDLTVDKSRWQQGNVFSCSVMHEALHNHYTQKSLSLSPGGGSSPPMPYDLY<br>HPSGPAPTSSSTKKTQLQLEHLLLDLQMILNGINNYKNPKLTRMLTFKFYMPKKATELKH<br>LQCLEEELKPLEEVLNLAQSKNFHLRPRDLISNINVIVLELKGSETTFMCEYADETATIVEF<br>LNRWITFAQSIISTLT |
| 664 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKELTKNQVSLWCLVKGFYPSDIAVEWESNGQPENNYKTTPPVL<br>KSDGSFFLYSKLTVDKSRWQQGNVFSCSVMHEALHNHYTQKSLSLSPGPGSGAVNGTSQ<br>FTCFYNSRANISCVWSQDGALQDTSCQVHAWPDRRRWNQTCELLPVSQASWACNLILG<br>APDSQKLTTVDIVTLRVLCREGVRWRVMAIQDFKPFENLRLMAPISLQVVHVETHRCNIS<br>WEISQASHYFERHLEFEARTLSPGHTWEEAPLLTLKQKQEWICLETLTPDTQYEFQVRVK<br>PLQGEFTTWSPWSQPLAFRTKPAALGKD |
| 665 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVEGFYPSDIAVEWESNGQPENNYKTTPPVLD<br>SDGSFFLVSKLTVDKSRWQQGNVFSCSVMHEALHNHYTQESLSLSPGGGSSPPMPYDLY<br>HPSGPAPTSSSTKKTQLQLEHLLLDLQMILNGINNYKNPKLTRMLTFKFYMPKKATELKH<br>LQCLEEELKPLEEVLNLAQSKNFHLRPRDLISNINVIVLELKGSETTFMCEYADETATIVEF<br>LNRWITFAQSIISTLT |
| 666 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLWCLVKGFYPSDIAVEWESNGQPENNYKTTPPVL<br>DSDGSFFLYSKLTVDKSRWQQGNVFSCSVMHEALHNHYTQKSLSLSPGPGSGAVNGTSQ<br>FTCFYNSRANISCVWSQDGALQDTSCQVHAWPDRRRWNQTCELLPVSQASWACNLILG<br>APDSQKLTTVDIVTLRVLCREGVRWRVMAIQDFKPFENLRLMAPISLQVVHVETHRCNIS |

IX. SEQUENCES

| SEQ ID | AMINO ACID SEQUENCE |
|---|---|
| | WEISQASHYFERHLEFEARTLSPGHTWEEAPLLTLKQKQEWICLETLTPDTQYEFQVRVK PLQGEFTTWSPWSQPLAFRTKPAALGKD |
| 667 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTAMLTAKFAMPKKATELK HLQCLEEALKPLEEVLNLAQSKNFHLRPRDLISNINVIVLELKGSETTFMCEYADETATIVE FLNRWITFAQSIISTLT |
| 668 | GGSSPPMPYDLYHPSGPGSGS |
| 669 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTAMLTAKFAMPKKATELK HLQCLEEALKPLEEVLNLAQSKNFHFDPRDVVSNINVFVLELKGSETTFMCEYADETATI VEFLNRWITFAQSIISTLT |
| 670 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPGGGSSPPMPYDLY HPSGPAPTSSSTKKTQLQLEHLLLDLQMILNGINNYKNPKLTRMLTFKFYMPKKATELKH LQCLEEELKPLEEVLNLAQSKNFHLRPRDLISNINVIVLELKGSETTFMCEYADETATIVEF LNRWITFAQSIISTLT |
| 671 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGPGSGAVNGTSQ FTCFYNSRANISCVWSQDGALQDTSCQVHAWPDRRRWNQTCELLPVSQASWACNLILG APDSQKLTTVDIVTLRVLCREGVRWRVMAIQDFKPFENLRLMAPISLQVVHVETHRCNIS WEISQASHYFERHLEFEARTLSPGHTWEEAPLLTLKQKQEWICLETLTPDTQYEFQVRVK PLQGEFTTWSPWSQPLAFRTKPAALGKD |
| 672 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGISSGLLSGRSD NHSGPAPTSSSTKKTQLQLEHLLLDLQMILNGINNYKNPKLTRMLTFKFYMPKKATELKH LQCLEEELKPLEEVLNLAQSKNFHLRPRDLISNINVIVLELKGSETTFMCEYADETATIVEF LNRWITFAQSIISTLT |
| 673 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGAVGLLAPPG GLSGRSDNHSGPAPTSSSTKKTQLQLEHLLLDLQMILNGINNYKNPKLTRMLTFKFYMPK KATELKHLQCLEEELKPLEEVLNLAQSKNFHLRPRDLISNINVIVLELKGSETTFMCEYAD ETATIVEFLNRWITFAQSIISTLT |
| 674 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPGVPLSLYSG PAPTSSSTKKTQLQLEHLLLDLQMILNGINNYKNPKLTRMLTFKFYMPKKATELKHLQCL EEELKPLEEVLNLAQSKNFHLRPRDLISNINVIVLELKGSETTFMCEYADETATIVEFLNRW ITFAQSIISTLT |
| 675 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPVPLSLY SGPAPTSSSTKKTQLQLEHLLLDLQMILNGINNYKNPKLTRMLTFKFYMPKKATELKHLQ CLEEELKPLEEVLNLAQSKNFHLRPRDLISNINVIVLELKGSETTFMCEYADETATIVEFLN RWITFAQSIISTLT |
| 676 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSPGGVPLSL |

| | IX. SEQUENCES |
|---|---|
| SEQ ID | AMINO ACID SEQUENCE |
| | YSGPAPTSSSTKKTQLQLEHLLLDLQMILNGINNYKNPKLTAMLTAKFAMPKKATELKHL QCLEEALKPLEEVLNLAQSKNFHLRPRDLISNINIVLELKGSETTFMCEYADETATIVEFL NRWITFAQSIISTLT |
| 677 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPRAAAV KSPSGPAPTSSSTKKTQLQLEHLLLDLQMILNGINNYKNPKLTRMLTFKFYMPKKATELK HLQCLEEELKPLEEVLNLAQSKNFHLRPRDLISNINIVLELKGSETTFMCEYADETATIVE FLNRWITFAQSIISTLT |
| 678 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGPGGPRAAAV KSPSGPAPTSSSTKKTQLQLEHLLLDLQMILNGINNYKNPKLTRMLTFKFYMPKKATELK HLQCLEEELKPLEEVLNLAQSKNFHLRPRDLISNINIVLELKGSETTFMCEYADETATIVE FLNRWITFAQSIISTLT |
| 679 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSGRAAAVKS PSGPAPTSSSTKKTQLQLEHLLLDLQMILNGINNYKNPKLTAMLTAKFAMPKKATELKHL QCLEEALKPLEEVLNLAQSKNFHLRPRDLISNINIVLELKGSETTFMCEYADETATIVEFL NRWITFAQSIISTLT |
| 680 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPRAAAV KSPSGPAPTSSSTKKTQLQLEHLLLDLQMILNGINNYKNPKLTAMLTAKFAMPKKATELK HLQCLEEALKPLEEVLNLAQSKNFHLRPRDLISNINIVLELKGSETTFMCEYADETATIVE FLNRWITFAQSIISTLT |
| 681 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGPGGPRAAAV KSPSGPAPTSSSTKKTQLQLEHLLLDLQMILNGINNYKNPKLTAMLTAKFAMPKKATELK HLQCLEEALKPLEEVLNLAQSKNFHLRPRDLISNINIVLELKGSETTFMCEYADETATIVE FLNRWITFAQSIISTLT |
| 682 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSGHEQLTVS GPAPTSSSTKKTQLQLEHLLLDLQMILNGINNYKNPKLTRMLTFKFYMPKKATELKHLQC LEEELKPLEEVLNLAQSKNFHLRPRDLISNINIVLELKGSETTFMCEYADETATIVEFLNR WITFAQSIISTLT |
| 683 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPHEQLT VSGPAPTSSSTKKTQLQLEHLLLDLQMILNGINNYKNPKLTRMLTFKFYMPKKATELKHL QCLEEELKPLEEVLNLAQSKNFHLRPRDLISNINIVLELKGSETTFMCEYADETATIVEFL NRWITFAQSIISTLT |
| 684 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPPGGHEQLT VSGPAPTSSSTKKTQLQLEHLLLDLQMILNGINNYKNPKLTRMLTFKFYMPKKATELKHL QCLEEELKPLEEVLNLAQSKNFHLRPRDLISNINIVLELKGSETTFMCEYADETATIVEFL NRWITFAQSIISTLT |
| 685 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSGHEQLTVS GPAPTSSSTKKTQLQLEHLLLDLQMILNGINNYKNPKLTAMLTAKFAMPKKATELKHLQ |

IX. SEQUENCES

| SEQ ID | AMINO ACID SEQUENCE |
|---|---|
|  | CLEEALKPLEEVLNLAQSKNFHLRPRDLISNINVIVLELKGSETTFMCEYADETATIVEFLN<br>RWITFAQSIISTLT |
| 686 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPHEQLT<br>VSGPAPTSSSTKKTQLQLEHLLLDLQMILNGINNYKNPKLTAMLTAKFAMPKKATELKHL<br>QCLEEALKPLEEVLNLAQSKNFHLRPRDLISNINVIVLELKGSETTFMCEYADETATIVEFL<br>NRWITFAQSIISTLT |
| 687 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGSPPGGHEQLT<br>VSGPAPTSSSTKKTQLQLEHLLLDLQMILNGINNYKNPKLTAMLTAKFAMPKKATELKHL<br>QCLEEALKPLEEVLNLAQSKNFHLRPRDLISNINVIVLELKGSETTFMCEYADETATIVEFL<br>NRWITFAQSIISTLT |
| 688 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGSGPDSGGFML<br>TSGPAPTSSSTKKTQLQLEHLLLDLQMILNGINNYKNPKLTRMLTFKFYMPKKATELKHL<br>QCLEEELKPLEEVLNLAQSKNFHLRPRDLISNINVIVLELKGSETTFMCEYADETATIVEFL<br>NRWITFAQSIISTLT |
| 689 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGPGSPGDSGGF<br>MLTSGPAPTSSSTKKTQLQLEHLLLDLQMILNGINNYKNPKLTRMLTFKFYMPKKATELK<br>HLQCLEEELKPLEEVLNLAQSKNFHLRPRDLISNINVIVLELKGSETTFMCEYADETATIVE<br>FLNRWITFAQSIISTLT |
| 690 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGSSPPGDSGGF<br>MLTSGPAPTSSSTKKTQLQLEHLLLDLQMILNGINNYKNPKLTRMLTFKFYMPKKATELK<br>HLQCLEEELKPLEEVLNLAQSKNFHLRPRDLISNINVIVLELKGSETTFMCEYADETATIVE<br>FLNRWITFAQSIISTLT |
| 691 | GISSGLLSGRSDNHGGP |
| 692 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGPGSPGDSGGF<br>MLTSGPAPTSSSTKKTQLQLEHLLLDLQMILNGINNYKNPKLTAMLTAKFAMPKKATELK<br>HLQCLEEALKPLEEVLNLAQSKNFHLRPRDLISNINVIVLELKGSETTFMCEYADETATIVE<br>FLNRWITFAQSIISTLT |
| 693 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGSSPPGDSGGF<br>MLTSGPAPTSSSTKKTQLQLEHLLLDLQMILNGINNYKNPKLTAMLTAKFAMPKKATELK<br>HLQCLEEALKPLEEVLNLAQSKNFHLRPRDLISNINVIVLELKGSETTFMCEYADETATIVE<br>FLNRWITFAQSIISTLT |
| 694 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGISSGLLSGRSD<br>NHSGPAPTSSSTKKTQLQLEHLLLDLQMILNGINNYKNPKLTAMLTAKFAMPKKATELK<br>HLQCLEEALKPLEEVLNLAQSKNFHLRPRDLISNINVIVLELKGSETTFMCEYADETATIVE<br>FLNRWITFAQSIISTLT |
| 695 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGAVGLLAPPG<br>GLSGRSDNHSGPAPTSSSTKKTQLQLEHLLLDLQMILNGINNYKNPKLTAMLTAKFAMPK |

IX. SEQUENCES

| SEQ ID | AMINO ACID SEQUENCE |
|---|---|
| | KATELKHLQCLEEALKPLEEVLNLAQSKNFHLRPRDLISNINIVLELKGSETTFMCEYAD ETATIVEFLNRWITFAQSIISTLT |
| 696 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSPGGVPLSL YSGPAPTSSSTKKTQLQLEHLLLDLQMILNGINNYKNPKLTRMLTFKFYMPKKATELKHL QCLEEELKPLEEVLNLAQSKNFHLRPRDLISNINIVLELKGSETTFMCEYADETATIVEFL NRWITFAQSIISTLT |
| 697 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSPGVPLSLYSG PAPTSSSTKKTQLQLEHLLLDLQMILNGINNYKNPKLTAMLTAKFAMPKKATELKHLQCL EEALKPLEEVLNLAQSKNFHLRPRDLISNINIVLELKGSETTFMCEYADETATIVEFLNR WITFAQSIISTLT |
| 698 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSGRAAAVKS PSGPAPTSSSTKKTQLQLEHLLLDLQMILNGINNYKNPKLTRMLTFKFYMPKKATELKHL QCLEEELKPLEEVLNLAQSKNFHLRPRDLISNINIVLELKGSETTFMCEYADETATIVEFL NRWITFAQSIISTLT |
| 699 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPGGGSS GGGSGPAPTSSSTKKTQLQLEHLLLDLQMILNGINNYKNPKLTAMLTAKFAMPKKATEL KHLQCLEEALKPLEEVLNLAQSKNFHLRPRDLISNINIVLELKGSETTFMCEYADETATI VEFLNRWITFAQSIISTLT |
| 700 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPGGGSS GGGSGPAPTSSSTKKTQLQLEHLLLDLQMILNGINNYKNPKLTRMLTFKFYMPKKATELK HLQCLEEEELKPLEEVLNLAQSKNFHLRPRDLISNINIVLELKGSETTFMCEYADETATIVE FLNRWITFAQSIISTLT |
| 701 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTRMLTFKFYMPKKATELK HLQCLEERLKPLEEVLNLAQSKNFHLRPRDLISNINIVLELKGSETTFMCEYADETATIVE FLNRWITFAQSIISTLT |
| 702 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTRMLTEKFYMPKKATELK HLQCLEEELKPLEEVLNLAQSKNFHLRPRDLISNINIVLELKGSETTFMCEYADETATIVE FLNRWITFAQSIISTLT |
| 703 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTRMLTFKFNMPKKATELK HLQCLEEELKPLEEVLNLAQSKNFHLRPRDLISNINIVLELKGSETTFMCEYADETATIVE FLNRWITFAQSIISTLT |
| 704 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTRMLTFKFYMPKKATELK HLQCLEESLKPLEEVLNLAQSKNFHLRPRDLISNINIVLELKGSETTFMCEYADETATIVE FLNRWITFAQSIISTLT |

| | IX. SEQUENCES |
|---|---|
| SEQ ID | AMINO ACID SEQUENCE |
| 705 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTRMLTAKFYMPKKATELK HLQCLEEELKPLEEVLNLAQSKNFHLRPRDLISNINVIVLELKGSETTFMCEYADETATIVE FLNRWITFAQSIISTLT |
| 706 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTRMLTFKFRMPKKATELK HLQCLEEEELKPLEEVLNLAQSKNFHLRPRDLISNINVIVLELKGSETTFMCEYADETATIVE FLNRWITFAQSIISTLT |
| 707 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTRMLTFAFYMPKKATELK HLQCLEEELKPLEEVLNLAQSKNFHLRPRDLISNINVIVLELKGSETTFMCEYADETATIVE FLNRWITFAQSIISTLT |
| 708 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTRMLTFKFAMPKKATELK HLQCLEESLKPLEEVLNLAQSKNFHLRPRDLISNINVIVLELKGSETTFMCEYADETATIVE FLNRWITFAQSIISTLT |
| 709 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTRMLTSKFYMPKKATELK HLQCLEESLKPLEEVLNLAQSKNFHLRPRDLISNINVIVLELKGSETTFMCEYADETATIVE FLNRWITFAQSIISTLT |
| 710 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPAPTSSSTKKTQLQLEHLLLDLQMILNGINNYKNPKLTGMLTFKFAMPKKATELK HLQCLEESLKPLEEVLNLAQSKNFHLRPRDLISNINVIVLELKGSETTFMCEYADETATIVE FLNRWITFAQSIISTLT |
| 711 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPVPLSLY SGPAPTSSSTKKTQLQLEHLLLDLQMILNGINNYKNPKLTAMLTAKFAMPKKATELKHLQ CLEEALKPLEEVLNLAQSKNFHLRPRDLISNINVIVLELKGSETTFMCEYADETATIVEFLN RWITFAQSIISTLT |
| 712 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPGPGSGAVNGTSQF TCFYNSRANTSCVWSQDGALQDTSCQVHAWPDRRRWNQTCELLPVSQASWACNLILGA PDSQKLTTVDIVTLRVLCREGVRWRVMAIQDFKPFENLRLMAPISLQVVHVETHRCNISW EISQASHYFERHLEFEARTLSPGHTWEEAPLLTLKQKQEWICLETLTPDTQYEFQVRVKPL QGEFTTWSPWSQPLAFRTKPAALGKD |
| 713 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGISSGLLSGRSD NHGGPAPTSSSTKKTQLQLEHLLLDLQMILNGINNYKNPKLTRMLTFKFYMPKKATELKH LQCLEEELKPLEEVLNLAQSKNFHLRPRDLISNINVIVLELKGSETTFMCEYADETATIVEF LNRWITFAQSIISTLT |

-continued

IX. SEQUENCES

| SEQ ID | AMINO ACID SEQUENCE |
|---|---|
| 714 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGISSGLLSGRSD NHGGPAPTSSSTKKTQLQLEHLLLDLQMILNGINNYKNPKLTAMLTAKFAMPKKATELK HLQCLEEALKPLEEVLNLAQSKNFHLRPRDLISNINVIVLELKGSETTFMCEYADETATIVE FLNRWITFAQSIISTLT |
| 715 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSSPPMPYDL YHPSGPGSGSNWVNVISDLKKIEDLIQSMHIDATLYTESDVHPSCKVTAMKCFLLELQVIS LESGDASIHDTVENLIILANNSLSSNGNVTESGCKECEELEEKNIKEFLQSFVHIVQMFINTS |
| 716 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPGGPPSGSSPMPYDL YHPSGGGAVNGTSQFTCFYNSRANISCVWSQDGALQDTSCQVHAWPDRRRWNQTCELL PVSQASWACNLILGAPDSQKLTTVDIVTLRVLCREGVRWRVMAIQDFKPFENLRLMAPIS LQVVHVETHRCNISWEISQASHYFERHLEFEARTLSPGHTWEEAPLLTLKQKQEWICLETL TPDTQYEFQVRVKPLQGEFTTWSPWSQPLAFRTKPAALGKD |
| 717 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPGVPLSLYSG PAPTSSSTKKTQLQLEHLLLDLQMILNGINNYKNPKLTRMLTFKFYMPKKATELKHLQCL EERLKPLEEVLNLAQSKNFHLRPRDLISNINVIVLELKGSETTFMCEYADETATIVEFLNR WITFAQSIISTLT |
| 718 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPGVPLSLYSG PAPTSSSTKKTQLQLEHLLLDLQMILNGINNYKNPKLTRMLTEKFYMPKKATELKHLQCL EEELKPLEEVLNLAQSKNFHLRPRDLISNINVIVLELKGSETTFMCEYADETATIVEFLNRW ITFAQSIISTLT |
| 719 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPGVPLSLYSG PAPTSSSTKKTQLQLEHLLLDLQMILNGINNYKNPKLTRMLTFKFYMPKKATELKHLQCL EESLKPLEEVLNLAQSKNFHLRPRDLISNINVIVLELKGSETTFMCEYADETATIVEFLNRW ITFAQSIISTLT |
| 720 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPGVPLSLYSG PAPTSSSTKKTQLQLEHLLLDLQMILNGINNYKNPKLTRMLTAKFYMPKKATELKHLQCL EEELKPLEEVLNLAQSKNFHLRPRDLISNINVIVLELKGSETTFMCEYADETATIVEFLNRW ITFAQSIISTLT |
| 721 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLTCLVEGFYPSDIAVEWESNGQPENNYKTTPPVLD SDGSFFLYSKLTVDKSRWQQGNVFSCSVMHEALHNHYTQESLSLSPG |
| 722 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPGVPLSLYSG PAPTSSSTKKTQLEHLLLDLQMILNGINNYKNPKLTRMLTFKFRMPKKATELKHLQCL EELKPLEEVLNLAQSKNFHLRPRDLISNINVIVLELKGSETTFMCEYADETATIVEFLNRW ITFAQSIISTLT |
| 723 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPGVPLSLYSG |

IX. SEQUENCES

| SEQ ID | AMINO ACID SEQUENCE |
|---|---|
| | PAPTSSSTKKTQLQLEHLLLDLQMILNGINNYKNPKLTRMLTSKFYMPKKATELKHLQCL EESLKPLEEVLNLAQSKNFHLRPRDLISNINVIVLELKGSETTFMCEYADETATIVEFLNRW ITFAQSIISTLT |
| 724 | GISSGLLSGRSDNPSGP |
| 725 | GGSGISSGLLSGRSDNPSGP |
| 726 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGSPGVPLSLYSG PAPTSSSTKKTQLQLEHLLLDLQMILNGINNYKNPKTAMLTAKFAMPKKATELKHLQCL EEALKPLEEVLNLAQSKNFHLRPRDLISNINVIVLELKGSETTFMCEYADETATIVEFLNR WITFAQSIISTLT |
| 727 | SGS |
| 728 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSGRAAAVKS PSGPAPTSSSTKKTQLQLEHLLLDLQMILNGINNYKNPKLTRMLTSKFYMPKKATELKHL QCLEESLKPLEEVLNLAQSKNFHLRPRDLISNINVIVLELKGSETTFMCEYADETATIVEFL NRWITFAQSIISTLT |
| 729 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGISSGLLSGRSS GPAPTSSSTKKTQLQLEHLLLDLQMILNGINNYKNPKLTRMLTSKFYMPKKATELKHLQC LEESLKPLEEVLNLAQSKNFHLRPRDLISNINVIVLELKGSETTFMCEYADETATIVEFLNR WITFAQSIISTLT |
| 730 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSGISSGLLSG RSSGPAPTSSSTKKTQLQLEHLLLDLQMILNGINNYKNPKLTRMLTSKFYMPKKATELKH LQCLEESLKPLEEVLNLAQSKNFHLRPRDLISNINVIVLELKGSETTFMCEYADETATIVEF LNRWITFAQSIISTLT |
| 731 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGISSGLLSGRSD NPSGPAPTSSSTKKTQLQLEHLLLDLQMILNGINNYKNPKLTRMLTSKFYMPKKATELKH LQCLEESLKPLEEVLNLAQSKNFHLRPRDLISNINVIVLELKGSETTFMCEYADETATIVEF LNRWITFAQSIISTLT |
| 732 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSGISSGLLSG RSDNPSGPAPTSSSTKKTQLQLEHLLLDLQMILNGINNYKNPKLTRMLTSKFYMPKKATE LKHLQCLEESLKPLEEVLNLAQSKNFHLRPRDLISNINVIVLELKGSETTFMCEYADETATI VEFLNRWITFAQSIISTLT |
| 733 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGISSGLLSGRSD QPSGPAPTSSSTKKTQLQLEHLLLDLQMILNGINNYKNPKLTRMLTSKFYMPKKATELKH LQCLEESLKPLEEVLNLAQSKNFHLRPRDLISNINVIVLELKGSETTFMCEYADETATIVEF LNRWITFAQSIISTLT |
| 734 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVYTLPPCRDELTKNQVSLWCLVKGFYPSDIAVEWESNGQPENNYKTTPPVL DSDGSFFLYSKLTVDKSRWQQGNVFSCSVMHEALHNHYTQKSLSLSPGGGSGISSGLLSG RSDQPSGPAPTSSSTKKTQLQLEHLLLDLQMILNGINNYKNPKLTRMLTSKFYMPKKATE LKHLQCLEESLKPLEEVLNLAQSKNFHLRPRDLISNINVIVLELKGSETTFMCEYADETATI VEFLNRWITFAQSIISTLT |

IX. SEQUENCES

| SEQ ID | AMINO ACID SEQUENCE |
|---|---|
| 735 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGKQLRVVNEYS<br>SMDNMLLGGPAPTSSSTKKTQLQLEHLLLDLQMILNGINNYKNPKLTRMLTSKFYMPKK<br>ATELKHLQCLEESLKPLEEVLNLAQSKNFHLRPRDLISNINVIVLELKGSETTFMCEYADE<br>TATIVEFLNRWITFAQSIISTLT |
| 736 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGKQLRVVNEYS<br>SEDNMLLGGPAPTSSSTKKTQLQLEHLLLDLQMILNGINNYKNPKLTRMLTSKFYMPKK<br>TELKHLQCLEESLKPLEEVLNLAQSKNFHLRPRDLISNINVIVLELKGSETTFMCEYADET<br>ATIVEFLNRWITFAQSIISTLT |
| 737 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGKQLRVVNGYS<br>SEDNMLLGGPAPTSSSTKKTQLQLEHLLLDLQMILNGINNYKNPKLTRMLTSKFYMPKKA<br>TELKHLQCLEESLKPLEEVLNLAQSKNFHLRPRDLISNINVIVLELKGSETTFMCEYADET<br>ATIVEFLNRWITFAQSIISTLT |
| 738 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGKQLRVVGGL<br>VHLKNTMETGPAPTSSSTKKTQLQLEHLLLDLQMILNGINNYKNPKLTRMLTSKFYMPK<br>KATELKHLQCLEESLKPLEEVLNLAQSKNFHLRPRDLISNINVIVLELKGSETTFMCEYAD<br>ETATIVEFLNRWITFAQSIISTLT |
| 739 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGTRDRLDEVNF<br>KQLRVVNGGPAPTSSSTKKTQLQLEHLLLDLQMILNGINNYKNPKLTRMLTSKFYMPKK<br>ATELKHLQCLEESLKPLEEVLNLAQSKNFHLRPRDLISNINVIVLELKGSETTFMCEYADE<br>TATIVEFLNRWITFAQSIISTLT |
| 740 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGTRDRLDEVNF<br>KLLRVVNGGPAPTSSSTKKTQLQLEHLLLDLQMILNGINNYKNPKLTRMLTSKFYMPKK<br>ATELKHLQCLEESLKPLEEVLNLAQSKNFHLRPRDLISNINVIVLELKGSETTFMCEYADE<br>TATIVEFLNRWITFAQSIISTLT |
| 741 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGTRDRLDPVNF<br>KQLRVVNGGPAPTSSSTKKTQLQLEHLLLDLQMILNGINNYKNPKLTRMLTSKFYMPKK<br>ATELKHLQCLEESLKPLEEVLNLAQSKNFHLRPRDLISNINVIVLELKGSETTFMCEYADE<br>TATIVEFLNRWITFAQSIISTLT |
| 742 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGTRDRLDPVNF<br>KLLRVVNGGPAPTSSSTKKTQLQLEHLLLDLQMILNGINNYKNPKLTRMLTSKFYMPKK<br>ATELKHLQCLEESLKPLEEVLNLAQSKNFHLRPRDLISNINVIVLELKGSETTFMCEYADE<br>TATIVEFLNRWITFAQSIISTLT |
| 743 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGNPMGSEPVNF<br>KQLRVVNGGPAPTSSSTKKTQLQLEHLLLDLQMILNGINNYKNPKLTRMLTSKFYMPKK<br>ATELKHLQCLEESLKPLEEVLNLAQSKNFHLRPRDLISNINVIVLELKGSETTFMCEYADE<br>TATIVEFLNRWITFAQSIISTLT |
| 744 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA |

IX. SEQUENCES

| SEQ ID | AMINO ACID SEQUENCE |
|---|---|
| | KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGNPMGSEPVNF<br>KLLRVVNGGPAPTSSSTKKTQLQLEHLLLDLQMILNGINNYKNPKLTRMLTSKFYMPKK<br>ATELKHLQCLEESLKPLEEVLNLAQSKNFHLRPRDLISNINVIVLELKGSETTFMCEYADE<br>TATIVEFLNRWITFAQSIISTLT |
| 745 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGNPMGSDPVNF<br>KQLRVVNGGPAPTSSSTKKTQLQLEHLLLDLQMILNGINNYKNPKLTRMLTSKFYMPKK<br>ATELKHLQCLEESLKPLEEVLNLAQSKNFHLRPRDLISNINVIVLELKGSETTFMCEYADE<br>TATIVEFLNRWITFAQSIISTLT |
| 746 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGNPMGSDPVNF<br>KLLRVVNGGPAPTSSSTKKTQLQLEHLLLDLQMILNGINNYKNPKLTRMLTSKFYMPKK<br>ATELKHLQCLEESLKPLEEVLNLAQSKNFHLRPRDLISNINVIVLELKGSETTFMCEYADE<br>TATIVEFLNRWITFAQSIISTLT |
| 747 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPSGSPGNWVNVISDLKKIEDLIQSMHIDATLYTESDVHPSCKVTAMKCFLLELQVI<br>SLESGDASIHDTVENLIILANNSLSSNGNVTESGCKECEELEEKNIKEFLQSFVHIVQMFINT<br>S |
| 748 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPGGGSS<br>GGGGSGPSGSPGNWVNVISDLKKIEDLIQSMHIDATLYTESDVHPSCKVTAMKCFLLELQVI<br>SLESGDASIHDTVENLIILANNSLSSNGNVTESGCKECEELEEKNIKEFLQSFVHIVQMFINT<br>S |
| 749 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPSGSPGNWVNVISDLKKIEDLIQSMHIDATLYTESDVHPSCKVTAMKCFLLELQVI<br>SLESGDASIHDTVENLIILANNSLSSNGNVTESGCKECEELEEKNIKEFLQSFVHIVQMFINT<br>SGGGGSGGGGSGGGGSGGGGSITCPPPMSVEHADIWVKSYSLYSRERYICNSGFKRKAGT<br>SSLTECVLNKATNVAHWTTPSLKCIRDPALVHQRPAPPSTVTTAGVTPQPESLSPSGKEPA<br>ASSPSSNNTAATTAAIVPGSQLMPSKSPSTGTTEISSHESSHGTPSQTTAKNWELTASASHQ<br>PPGVYPQGHSDTT |
| 750 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPSGSPGNWVNVISDLKKIEDLIQSMHIDATLYTESDVHPSCKVTAMKCFLLELQVI<br>SLESGDASIHDTVENLIILANNSLSSNGNVTESGCKECEELEEKNIKEFLQSFVHIVQMFINT<br>SGGGGSGGGGSGGGGSGGGGSITCPPPMSVEHADIWVKSYSLYSRERYICNSGFKRKAGT<br>SSLTECVLNKATNVAHWTTPSLKCIRDPALVHQRPAPPSTVTTAGVTPQPESLSPSGKEPA<br>AS |
| 751 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPGGGSS<br>GGGSGPSGSNWVNVISDLKKIEDLIQSMHIDATLYTESDVHPSCKVTAMKCFLLELQVIS<br>LESGDASIHDTVENLIILANNSLSSNGNVTESGCKECEELEEKNIKEFLQSFVHIVQMFINTS |
| 752 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPSGSNWVNVISDLKKIEDLIQSMHIDATLYTESDVHPSCKVTAMKCFLLELQVIS<br>LESGDASIHDTVENLIILANNSLSSNGNVTESGCKECEELEEKNIKEFLQSFVHIVQMFINTS<br>GGGGSGGGGSGGGGSGGGGSITCPPPMSVEHADIWVKSYSLYSRERYICNSGFKRKAGTS<br>SLTECVLNKATNVAHWTTPSLKCIRDPALVHQRPAPPSTVTTAGVTPQPESLSPSGKEPAA |

-continued

| IX. SEQUENCES |
|---|

| SEQ ID | AMINO ACID SEQUENCE |
|---|---|
| | SSPSSNNTAATTAAIVPGSQLMPSKSPSTGTTEISSHESSHGTPSQTTAKNWELTASASHQP<br>PGVYPQGHSDTT |
| 753 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPMPYDL<br>YHPSGPGSGSNWVNVISDLKKIEDLIQSMHIDATLYTESDVHPSCKVTAMKCFLLELQVIS<br>LESGDASIHDTVENLIILANNSLSSNGNVTESGCKECEELEEKNIKEFLQSFVHIVQMFINTS<br>GGGGSGGGGSGGGGSGGGGSITCPPPMSVEHADIWVKSYSLYSRERYICNSGFKRKAGTS<br>SLTECVLNKATNVAHWTTPSLKCIRDPALVHQRPAPPSTVTTAGVTPQPESLSPSGKEPAA<br>S |
| 754 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPVPLSLY<br>SGPGSGSNWVNVISDLKKIEDLIQSMHIDATLYTESDVHPSCKVTAMKCFLLELQVISLES<br>GDASIHDTVENLIILANNSLSSNGNVTESGCKECEELEEKNIKEFLQSFVHIVQMFINTS |
| 755 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVKGFYPSDIAVEWESNGQPENNYKTTPPVLD<br>SDGSFFLVSKLTVDKSRWQQGNVFSCSVMHEALHNHYTQKSLSLSPGPGSGSAVNGTSQ<br>FTCFYNSRANISCVWSQDGALQDTSCQVHAWPDRRRWNQTCELLPVSQASWACNLILG<br>APDSQKLTTVDIVTLRVLCREGVRWRVMAIQDFKPFENLRLMAPISLQVVHVETHRCNIS<br>WEISQASHYFERHLEFEARTLSPGHTWEEAPLLTLKQKQEWICLETLTPDTQYEFQVRVK<br>PLQGEFTTWSPWSQPLAFRTKPAALGKDPGGPSPVPLSLYSGGPITCPPPMSVEHADIWVK<br>SYSLYSRERYICNSGFKRKAGTSSLTECVLNKATNVAHWTTPSLKCIRDPALVHQRPAPPS<br>GGGGSGGGGSGGGGSGGGGSNWVNVISDLKKIEDLIQSMHIDATLYTESDVHPSCKVTA<br>MKCFLLELQVISLESGDASIHDTVENLIILANNSLSSNGNVTESGCKECEELEEKNIKEFLQ<br>SFVHIVQMFINTS |
| 756 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVKGFYPSDIAVEWESNGQPENNYKTTPPVLD<br>SDGSFFLVSKLTVDKSRWQQGNVFSCSVMHEALHNHYTQKSLSLSPGPGSGSAVNGTSQ<br>FTCFYNSRANISCVWSQDGALQDTSCQVHAWPDRRRWNQTCELLPVSQASWACNLILG<br>APDSQKLTTVDIVTLRVLCREGVRWRVMAIQDFKPFENLRLMAPISLQVVHVETHRCNIS<br>WEISQASHYFERHLEFEARTLSPGHTWEEAPLLTLKQKQEWICLETLTPDTQYEFQVRVK<br>PLQGEFTTWSPWSQPLAFRTKPAALGKDSGSGGSPVPLSLYSGGPITCPPPMSVEHADIWV<br>KSYSLYSRERYICNSGFKRKAGTSSLTECVLNKATNVAHWTTPSLKCIRDPALVHQRPAP<br>PSGGGGSGGGGSGGGGSGGGGSNWVNVISDLKKIEDLIQSMHIDATLYTESDVHPSCKVT<br>AMKCFLLELQVISLESGDASIHDTVENLIILANNSLSSNGNVTESGCKECEELEEKNIKEFL<br>QSFVHIVQMFINTS |
| 757 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVCTLPPSRDELTKNQVSLSCAVKGFYPSDIAVEWESNGQPENNYKTTPPVLD<br>SDGSFFLVSKLTVDKSRWQQGNVFSCSVMHEALHNHYTQKSLSLSPGPGSGSAVNGTSQ<br>FTCFYNSRANISCVWSQDGALQDTSCQVHAWPDRRRWNQTCELLPVSQASWACNLILG<br>APDSQKLTTVDIVTLRVLCREGVRWRVMAIQDFKPFENLRLMAPISLQVVHVETHRCNIS<br>WEISQASHYFERHLEFEARTLSPGHTWEEAPLLTLKQKQEWICLETLTPDTQYEFQVRVK<br>PLQGEFTTWSPWSQPLAFRTKPAALGKDGGGSSPVPLSLYSGGPITCPPPMSVEHADIWV<br>KSYSLYSRERYICNSGFKRKAGTSSLTECVLNKATNVAHWTTPSLKCIRDPALVHQRPAP<br>PSGGGGSGGGGSGGGGSGGGGSNWVNVISDLKKIEDLIQSMHIDATLYTESDVHPSCKVT<br>AMKCFLLELQVISLESGDASIHDTVENLIILANNSLSSNGNVTESGCKECEELEEKNIKEFL<br>QSFVHIVQMFINTS |
| 758 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPVPLSLY<br>SGPGSGPGNWVNVISDLKKIEDLIQSMHIDATLYTESDVHPSCKVTAMKCFLLELQVISLE<br>SGDASIHDTVENLIILANNSLSSNGNVTESGCKECEELEEKNIKEFLQSFVHIVQMFINTSG<br>GSGGGSGGGSGGGSGSITCPPPMSVEHADIWVKSYSLYSRERYICNSGFKRKAGTSS<br>LTECVLNKATNVAHWTTPSLKCIRDPALVHQRPAPPSTVTTAGVTPQPESLSPSGKEPAAS<br>SPSSNNTAATTAAIVPGSQLMPSKSPSTGTTEISSHESSHGTPSQTTAKNWELTASASHQPP<br>GVYPQGHSDTT |
| 759 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPVPLSLY |

| SEQ ID | AMINO ACID SEQUENCE |
|---|---|
| | SGPSGSPGNWVNVISDLKKIEDLIQSMHIDATLYTESDVHPSCKVTAMKCFLLELQVISLE<br>SGDASIHDTVENLIILANNSLSSNGNVTESGCKECEELEEKNIKEFLQSFVHIVQMFINTSG<br>GSGGGSGGGSGGGSGGGSGGGSITCPPPMSVEHADIWVKSYSLYSRERYICNSGFKRKA<br>GTSSLTECVLNKATNVAHWTTPSLKCIRDPALVHQRPAPPSTVTTAGVTPQPESLSPSGKE<br>PAASSPSSNNTAATTAAIVPGSQLMPSKSPSTGTTEISSHESSHGTPSQTTAKNWELTASAS<br>HQPPGVYPQGHSDTT |
| 760 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPVPLSLY<br>SGPSGSGNWVNVISDLKKIEDLIQSMHIDATLYTESDVHPSCKVTAMKCFLLELQVISLES<br>GDASIHDTVENLIILANNSLSSNGNVTESGCKECEELEEKNIKEFLQSFVHIVQMFINTSGG<br>GGSGGGGSGGGGSGGGGSGGGGSITCPPPMSVEHADIWVKSYSLYSRERYICNSGFKRKA<br>GTSSLTECVLNKATNVAHWTTPSLKCIRDPALVHQRPAPPSTVTTAGVTPQPESLSPSGKE<br>PAAS |
| 761 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRDELTKNQVSLWCLVKGFYPSDIAVEWESNGQPENNYKTTPPVL<br>DSDGSFFLYSKLTVDKSRWQQGNVFSCSVMHEALHNHYTQKSLSLSPGGGSSPPVPLSLY<br>SGPSGSGNWVNVISDLKKIEDLIQSMHIDATLYTESDVHPSCKVTAMKCFLLELQVISLES<br>GDASIHDTVENLIILANNSLSSNGNVTESGCKECEELEEKNIKEFLQSFVHIVQMFINTSGG<br>GGSGGGGSGGGGSGGGGSGGGGSITCPPPMSVEHADIWVKSYSLYSRERYICNSGFKRKA<br>GTSSLTECVLNKATNVAHWTTPSLKCIRDPALVHQRPAPPSTVTTAGVTPQPESLSPSGKE<br>PAASSPSSNNTAATTAAIVPGSQLMPSKSPSTGTTEISSHESSHGTPSQTTAKNWELTASAS<br>HQPPGVYPQGHSDTT |
| 762 | PGPGPMPYDLYHPSGGCGGHQYERRGGC |
| 763 | PGPGPMPYDLYHPSGGCSGHQYERREGC |
| 764 | PGPGPMPYDLYHPSGGCGGHYFERHGGC |
| 765 | PGPGPMPYDLYHPSGGCSGHYFERHEGC |
| 766 | PGPGPMPYDLYHPSGGCSFHQYERHEGC |
| 767 | PSGSSMPYDLYHPSGGCGGHQYERRGGC |
| 768 | PSGSSMPYDLYHPSGGCSGHQYERREGC |
| 769 | PSGSSMPYDLYHPSGGCGGHYFERHGGC |
| 770 | PSGSSMPYDLYHPSGGCSGHYFERHEGC |
| 771 | PSGSSMPYDLYHPSGGCSFHQYERHEGC |
| 772 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLTCLVKGFYPSDIAVEWESNGQPENNYKTTPPVLD<br>SDGSFFLYSKLTVDKSRWQQGNVFSCSVMHEALHNHYTQKSLSLSPG |
| 773 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKELTKNQVSLWCLVKGFYPSDIAVEWESNGQPENNYKTTPPVL<br>KSDGSFFLYSKLTVDKSRWQQGNVFSCSVMHEALHNHYTQKSLSLSPG |
| 774 | DKTHTCPPCPAPELLGGPSVFLFPPKPKDTLMISRTPEVTCVVVDVSHEDPEVKFNWYVD<br>GVEVHNAKTKPREEQYASTYRVVSVLTVLHQDWLNGKEYKCKVSNKALPAPIEKTISKA<br>KGQPREPQVYTLPPCRKKLTKNQVSLWCLVKGFYPSDIAVEWESNGQPENNYKTTPPVL<br>DSDGSFFLYSKLTVDKSRWQQGNVFSCSVMHEALHNHYTQKSLSLSPG |
| 775 | APTSSSTKKTQLQLEILCLLLQMILNGILNYKNPKLTRMLTFKFYMPKKATELKHLQCLEE<br>ELKPLEEVLNLAQSKNFHLRPRDLISNINVIVLELKGSETTFMCEYADETATIVEFLNRWIT<br>FCQSIISTLT |
| 776 | APTSSSTKKTQLQLEILLLLLQMILNGILNYKNPKLTRMLTFKFYMPKKATELKHLQCLEE<br>ELKPLEEVLNLAQSKNFHLRPRDLISNINVIVLELKGSETTFMCEYADETATIVEFLNRWIT<br>FIQSIISTLT |
| 777 | APTSSSTKKTQLQLEILCLFLQMILNGILNYKNPKLTRMLTFKFYMPKKATELKHLQCLEE<br>ELKPLEEVLNLAQSKNFHLRPRDLISNINVIVLELKGSETTFMCEYADETATIVEFLNRWIT<br>FCQSIISTLT |

IX. SEQUENCES

| SEQ ID | AMINO ACID SEQUENCE |
|---|---|
| 778 | APTSSSTKKTQLQLEILLLFLQMILNGILNYKNPKLTRMLTFKFYMPKKATELKHLQCLEE ELKPLEEVLNLAQSKNFHLRPRDLISNINVIVLELKGSETTFMCEYADETATIVEFLNRWIT FIQSIISTLT |
| 779 | APTSSSTKKTQLQLEHLCLLLQ MILNGILNYKNPKLTRMLTFKFYMPKKATELKHLQCLE EELKPLEEVLNLAQSKNFHLRPRDLISNINVIVLELKGSETTFMCEYADETATIVEFLNRWI TFCQSIISTLT |
| 780 | APTSSSTKKTQLQLEHLLLLLQMILNGILNYKNPKLTRMLTFKFYMPKKATELKHLQCLE EELKPLEEVLNLAQSKNFHLRPRDLISNINVIVLELKGSETTFMCEYADETATIVEFLNRWI TFIQSIISTLT |
| 781 | APTSSSTKKTQLQLEILLLLLQMILNGILNYKNPKLTRMLTFKFYMPKKATELKHLQCLEE ELKPLEEVLNLAQSKNFHLRPRDLISNINVIVLELKGSETTFMCEYADETATIVEFLNRWIT FAQSIISTLT |
| 782 | APTSSSTKKTQLQLEILLLFLQMILNGILNYKNPKLTRMLTFKFYMPKKATELKHLQCLEE ELKPLEEVLNLAQSKNFHLRPRDLISNINVIVLELKGSETTFMCEYADETATIVEFLNRWIT FAQSIISTLT |
| 783 | APTSSSTKKTQLQLEHLLLLLQMILNGILNYKNPKLTRMLTFKFYMPKKATELKHLQCLE EELKPLEEVLNLAQSKNFHLRPRDLISNINVIVLELKGSETTFMCEYADETATIVEFLNRWI TFAQSIISTLT |
| 784 | APTSSSTKKTQLQLEHLCLFLQMILNGILNYKNPKLTRMLTFKFYMPKKATELKHLQCLE EELKPLEEVLNLAQSKNFHLRPRDLISNINVIVLELKGSETTFMCEYADETATIVEFLNRWI TFCQSIISTLT |
| 785 | APTSSSTKKTQLQLEHLLLFLQMILNGILNYKNPKLTRMLTFKFYMPKKATELKHLQCLE EELKPLEEVLNLAQSKNFHLRPRDLISNINVIVLELKGSETTFMCEYADETATIVEFLNRWI TFIQSIISTLT |
| 786 | APTSSSTKKTQLQLEHLLLFLQMILNGILNYKNPKLTRMLTFKFYMPKKATELKHLQCLE EELKPLEEVLNLAQSKNFHLRPRDLISNINVIVLELKGSETTFMCEYADETATIVEFLNRWI TFAQSIISTLT |
| 787 | APTSSSTKKTQLQLEILCLLLQMILNGINNYKNPKLTRMLTFKFYMPKKATELKHLQCLEE ELKPLEEVLNLAQSKNFHLRPRDLISNINVIVLELKGSETTFMCEYADETATIVEFLNRWIT FCQSIISTLT |
| 788 | APTSSSTKKTQLQLEILLLLLQMILNGINNYKNPKLTRMLTFKFYMPKKATELKHLQCLEE ELKPLEEVLNLAQSKNFHLRPRDLISNINVIVLELKGSETTFMCEYADETATIVEFLNRWIT FIQSIISTLT |
| 789 | APTSSSTKKTQLQLEILLLLLQMILNGINNYKNPKLTRMLTFKFYMPKKATELKHLQCLEE ELKPLEEVLNLAQSKNFHLRPRDLISNINVIVLELKGSETTFMCEYADETATIVEFLNRWIT FAQSIISTLT |
| 790 | APTSSSTKKTQLQLEILCLFLQMILNGINNYKNPKLTRMLTFKFYMPKKATELKHLQCLEE ELKPLEEVLNLAQSKNFHLRPRDLISNINVIVLELKGSETTFMCEYADETATIVEFLNRWIT FCQSIISTLT |
| 791 | APTSSSTKKTQLQLEILLLFLQMILNGINNYKNPKLTRMLTFKFYMPKKATELKHLQCLEE ELKPLEEVLNLAQSKNFHLRPRDLISNINVIVLELKGSETTFMCEYADETATIVEFLNRWIT FIQSIISTLT |
| 792 | APTSSSTKKTQLQLEILLLFLQMILNGINNYKNPKLTRMLTFKFYMPKKATELKHLQCLEE ELKPLEEVLNLAQSKNFHLRPRDLISNINVIVLELKGSETTFMCEYADETATIVEFLNRWIT FAQSIISTLT |
| 793 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYDTTPPVLD SDGSFFLVSDLTVDKSRWQQGNVFSCSVMHEALHNHYTQKSLSLSPG |
| 794 | SG |
| 795 | PGSG |
| 796 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVEGFYPSDIAVEWESNGQPENNYKTTPPVLD SDGSFFLVSKLTVDKSRWQQGNVFSCSVMHEALHNHYTQESLSLSPG |

-continued

| IX. SEQUENCES | |
|---|---|
| SEQ ID | AMINO ACID SEQUENCE |

797 GISSGLLSGRSSGP

798 GGSGISSGLLSGRSSGP

799 GSG

800 GISSGLLSGRSDNHSGP

801 GGAVGLLAPPGGLSGRSDNHSGP

802 GSPGVPLSLYSGP

803 GGSSPPVPLSLYSGP

804 GGSPGGVPLSLYSGP

805 GGSSPPRAAAVKSPSGP

806 GGPGGPRAAAVKSPSGP

807 GGSGRAAAVKSPSGP

808 GGSGHEQLTVSGP

809 GGSSPPHEQLTVSGP

810 GSPPGGHEQLTVSGP

811 GSGPDSGGFMLTSGP

812 GPGSPGDSGGFMLTSGP

813 APTSSSTKKTQLQLEHLLLDLQMILNGINNYKNPKLTRMLTSKFYMPKKATELKHLQCLE
ESLKPLEEVLNLAQSKNFHLRPRDLISNINVIVLELKGSETTFMCEYADETATIVEFLNRWI
TFAQSIISTLT

814 APTSSSTKKTQLQLEHLLLDLQMILNGINNYKNPKLTGMLTFKFAMPKKATELKHLQCLE
ESLKPLEEVLNLAQSKNFHLRPRDLISNINVIVLELKGSETTFMCEYADETATIVEFLNRWI
TFAQSIISTLT

815 APTSSSTKKTQLQLEHLLLDLQMILNGINNYKNPKLTRMLTFKFYMPKKATELKHLQCLE
ERLKPLEEVLNLAQSKNFHLRPRDLISNINVIVLELKGSETTFMCEYADETATIVEFLNRWI
TFAQSIISTLT

816 APTSSSTKKTQLQLEHLLLDLQMILNGINNYKNPKLTRMLTEKFYMPKKATELKHLQCLE
EELKPLEEVLNLAQSKNFHLRPRDLISNINVIVLELKGSETTFMCEYADETATIVEFLNRWI
TFAQSIISTLT

817 APTSSSTKKTQLQLEHLLLDLQMILNGINNYKNPKLTRMLTFKFNMPKKATELKHLQCLE
EELKPLEEVLNLAQSKNFHLRPRDLISNINVIVLELKGSETTFMCEYADETATIVEFLNRWI
TFAQSIISTLT

818 APTSSSTKKTQLQLEHLLLDLQMILNGINNYKNPKLTRMLTFKFYMPKKATELKHLQCLE
ESLKPLEEVLNLAQSKNFHLRPRDLISNINVIVLELKGSETTFMCEYADETATIVEFLNRWI
TFAQSIISTLT

819 APTSSSTKKTQLQLEHLLLDLQMILNGINNYKNPKLTRMLTAKFYMPKKATELKHLQCLE
EELKPLEEVLNLAQSKNFHLRPRDLISNINVIVLELKGSETTFMCEYADETATIVEFLNRWI
TFAQSIISTLT

820 APTSSSTKKTQLQLEHLLLDLQMILNGINNYKNPKLTRMLTFKFRMPKKATELKHLQCLE
EELKPLEEVLNLAQSKNFHLRPRDLISNINVIVLELKGSETTFMCEYADETATIVEFLNRWI
TFAQSIISTLT

821 APTSSSTKKTQLQLEHLLLDLQMILNGINNYKNPKLTRMLTFAFYMPKKATELKHLQCLE
EELKPLEEVLNLAQSKNFHLRPRDLISNINVIVLELKGSETTFMCEYADETATIVEFLNRWI
TFAQSIISTLT

822 APTSSSTKKTQLQLEHLLLDLQMILNGINNYKNPKLTRMLTFKFAMPKKATELKHLQCLE
ESLKPLEEVLNLAQSKNFHLRPRDLISNINVIVLELKGSETTFMCEYADETATIVEFLNRWI
TFAQSIISTLT

-continued

IX. SEQUENCES

| SEQ ID | AMINO ACID SEQUENCE |
|---|---|
| 823 | ITCPPPMSVEHADIWVKSYSLYSRERYICNSGFKRKAGTSSLTECVLNKATNVAHWTTPS LKCIRDPALVHQRPAPPSTVTTAGVTPQPESLSPSGKEPAASSPSSNNTAATTAAIVPGSQL MPSKSPSTGTTEISSHESSHGTPSQTTAKNWELTASASHQPPGVYPQGHSDTT |
| 824 | ITCPPPMSVEHADIWVKSYSLYSRERYICNSGFKRKAGTSSLTECVLNKATNVAHWTTPS LKCIRDPALVHQRPAPPSTVTTAGVTPQPESLSPSGKEPAAS |
| 825 | ITCPPPMSVEHADIWVKSYSLYSRERYICNSGFKRKAGTSSLTECVLNKATNVAHWTTPS LKCIRDPALVHQRPAPPS |
| 826 | AVNGTSQFTCFYNSRANISCVWSQDGALQDTSCQVHAWPDRRRWNQTCELLPVSQASW ACNLILGAPDSQKLTTVDIVTLRVLCREGVRWRVMAIQDFKPFENLRLMAPISLQVVHVE THRSNISWEISQASHYFERHLEFEARTLSPGHTWEEAPLLTLKQKQEWISLETLTPDTQYE FQVRVKPLQGEFTTWSPWSQPLAFRTKPAALGKD |
| 827 | AVNGTSQFTCFYNSRANISCVWSQDGALQDTSCQVHAWPDRRRWNQTCELLPVSQASW ACNLILGAPDSQKLTTVDIVTLRVLCREGVRWRVMAIQDFKPFENLRLMAPISLQVVHVE THRSNISWEISQASHYFEDHLEFEARTLSPGHTWEEAPLLTLKWKQEWISLATLTPDTQYE FQVRVKPLQGEFTTWSPWSQPLAFRTKPAALGKD |
| 828 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPGPGSGSAVNGTSQ FTCFYNSRANISCVWSQDGALQDTSCQVHAWPDRRRWNQTCELLPVSQASWACNLILG APDSQKLTTVDIVTLRVLCREGVRWRVMAIQDFKPFENLRLMAPISLQVVHVETHRSNIS WEISQASHYFERHLEFEARTLSPGHTWEEAPLLTLKQKQEWISLETLTPDTQYEFQVRVKP LQGEFTTWSPWSQPLAFRTKPAALGKD |
| 829 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPGPGSGSAVNGTSQ FTCFYNSRANISCVWSQDGALQDTSCQVHAWPDRRRWNQTCELLPVSQASWACNLILG APDSQKLTTVDIVTLRVLCREGVRWRVMAIQDFKPFENLRLMAPISLQVVHVETHRSNIS WEISQASHYFEDHLEFEARTLSPGHTWEEAPLLTLKWKQEWISLATLTPDTQYEFQVRVK PLQGEFTTWSPWSQPLAFRTKPAALGKD |
| 830 | DKTHTCPPCPAPELLGGPSVFLFPPKPKDTLMISRTPEVTCVVVDVSHEDPEVKFNWYVD GVEVHNAKTKPREEQYASTYRVVSVLTVLHQDWLNGKEYKCKVSNKALPAPIEKTISKA KGQPREPQVCTLPPSRDELTKNQVSLSCAVKGFYPSDIAVEWESNGQPENNYKTTPPVLD SDGSFFLVSKLTVDKSRWQQGNVFSCSVMHEALHNHYTQKSLSLSPGPGSGSAVNGTSQ FTCFYNSRANISCVWSQDGALQDTSCQVHAWPDRRRWNQTCELLPVSQASWACNLILG APDSQKLTTVDIVTLRVLCREGVRWRVMAIQDFKPFENLRLMAPISLQVVHVETHRSNIS WEISQASHYFERHLEFEARTLSPGHTWEEAPLLTLKQKQEWISLETLTPDTQYEFQVRVKP LQGEFTTWSPWSQPLAFRTKPAALGKD |

SEQUENCE LISTING (830 sequences)

SEQ ID NO: 1 - protein, 133 aa, Artificial Sequence
  Synthetic Construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 2 - protein, 133 aa, Artificial Sequence
  Synthetic Construct
APTSSSTKKTQLQLEHLLLDLQMILNGINNYKNPKLTRMLTFKFYMPKKATELKHLQCLEEELKPLEEVLNLAQSKNFHFDPRDVVSNINVFVLELKGSETTFMCEYADETATIVEFLNRWITFAQSIISTLT

SEQ ID NO: 3 - protein, 133 aa, Artificial Sequence
  Synthetic Construct
APTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 4 - protein, 133 aa, Artificial Sequence
  Synthetic Construct
APTSSSTKKTQLQLEHLLLDLQMILNGINNYKNPKLTRMLTKKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 5 - protein, 133 aa, Artificial Sequence
  Synthetic Construct
APTSSSTKKTQLQLEHLLLDLQMILNGINNYKNPKLTRMLTFAFAMPKKATELKHLQCLEEELKPLEEVLNGAQSKNFHLRPRDLISNINVIVLELKGSETTFMCEYADETATIVEFLNRWITFAQSIISTLT

SEQ ID NO: 6 - protein, 133 aa, Artificial Sequence
  Synthetic Construct
APTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLT

SEQ ID NO: 7 - protein, 133 aa, Artificial Sequence
  Synthetic Construct
APTSSSTKKTQLQLEHLLLDLQMILNGINNYKNPKLTRMLTKKFYMPKKATELKHLQCLEEELKPLEEVLNLAQSKNFHFDPRDVVSNINVFVLELKGSETTFMCEYADETATIVEFLNRWITFAQSIISTLT

SEQ ID NO: 8 - protein, 133 aa, Artificial Sequence
  Synthetic Construct
APTSSSTKKTQLQLEHLLLDLQMILNGINNYKNPKLTRMLTAKFAMPKKATELKHLQCLEEELKPLEEVLNGAQSKNFHFDPRDVVSNINVFVLELKGSETTFMCEYADETATIVEFLNRWITFAQSIISTLT

SEQ ID NO: 9 - protein, 164 aa, Homo sapiens
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICT

SEQ ID NO: 10 - protein, 188 aa, Homo sapiens
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 11 - protein, 17 aa, Artificial Sequence
  Synthetic Construct
GGSSPPMPYDLYHPSGP

SEQ ID NO: 12 - protein, 11 aa, Artificial Sequence
  Synthetic Construct
GSPMPYDLYHP

SEQ ID NO: 13 - protein, 15 aa, Artificial Sequence
  Synthetic Construct
GSPPMPYDLYHPSGP

SEQ ID NO: 14 - protein, 15 aa, Artificial Sequence
  Synthetic Construct
GSPSMPYDLYHPSGP

SEQ ID NO: 15 - protein, 20 aa, Artificial Sequence
  Synthetic Construct
GPPSGSSPMPYDLYHPSGGG

SEQ ID NO: 16 - protein, 21 aa, Artificial Sequence
  Synthetic Construct
GSSGGPPGGMPYDLYHPSGGG

SEQ ID NO: 17 - protein, 22 aa, Artificial Sequence
  Synthetic Construct
SGSPSGSGGGMPYDLYHPSGGG

SEQ ID NO: 18 - protein, 22 aa, Artificial Sequence
  Synthetic Construct
GPPGPPGSSGMPYDLYHPSGGG

SEQ ID NO: 19 - protein, 23 aa, Artificial Sequence
  Synthetic Construct
GSSSGPPGPPSMPYDLYHPSGGG

SEQ ID NO: 20 - protein, 2 aa, Artificial Sequence
  Synthetic Construct
PA

SEQ ID NO: 21 - protein, 15 aa, Artificial Sequence
  Synthetic Construct
GGGGSGGGGSGGGGS

SEQ ID NO: 22 - protein, 10 aa, Artificial Sequence
  Synthetic Construct
PSGPSAGGAA

SEQ ID NO: 23 - protein, 9 aa, Artificial Sequence
  Synthetic Construct
GGPPASAGS

SEQ ID NO: 24 - protein, 9 aa, Artificial Sequence
  Synthetic Construct
GSPPAGGAP

SEQ ID NO: 25 - protein, 10 aa, Artificial Sequence
  Synthetic Construct
GPGSGSGGAA

SEQ ID NO: 26 - protein, 10 aa, Artificial Sequence
  Synthetic Construct
GGGGSGGGGS

SEQ ID NO: 27 - protein, 20 aa, Artificial Sequence
  Synthetic Construct
GGGGSGGGGSGGGGSGGGGS

SEQ ID NO: 28 - protein, 5 aa, Artificial Sequence
  Synthetic Construct
PGSGS

SEQ ID NO: 29 - protein, 35 aa, Artificial Sequence
  Synthetic Construct
GGGGGGGGGGGGGGGGGGGGGGGGGGGGGGGGGGG

SEQ ID NO: 30 - protein, 25 aa, Artificial Sequence
  Synthetic Construct
GGGGSGGGGSGGGGSGGGGSGGGGS

SEQ ID NO: 31 - protein, 30 aa, Artificial Sequence
  Synthetic Construct
GGGGSGGGGSGGGGSGGGGSGGGGSGGGGS

SEQ ID NO: 32 - protein, 35 aa, Artificial Sequence
  Synthetic Construct
GGGGSGGGGSGGGGSGGGGSGGGGSGGGGSGGGGS

SEQ ID NO: 33 - protein, 40 aa, Artificial Sequence
  Synthetic Construct
GGGGSGGGGSGGGGSGGGGSGGGGSGGGGSGGGGSGGGGS

SEQ ID NO: 34 - protein, 6 aa, Artificial Sequence
  Synthetic Construct
GGSSPP

SEQ ID NO: 35 - protein, 3 aa, Artificial Sequence
  Synthetic Construct
SGP

SEQ ID NO: 36 - protein, 3 aa, Artificial Sequence
  Synthetic Construct
GSP

SEQ ID NO: 37 - protein, 4 aa, Artificial Sequence
  Synthetic Construct
GSPP

SEQ ID NO: 38 - protein, 4 aa, Artificial Sequence
  Synthetic Construct
GSPS

SEQ ID NO: 39 - protein, 8 aa, Artificial Sequence
  Synthetic Construct
GPPSGSSP

SEQ ID NO: 40 - protein, 9 aa, Artificial Sequence
  Synthetic Construct
GSSGGPPGG

SEQ ID NO: 41 - protein, 10 aa, Artificial Sequence
  Synthetic Construct
SGSPSGSGGG

SEQ ID NO: 42 - protein, 10 aa, Artificial Sequence
  Synthetic Construct
GPPGPPGSSG

SEQ ID NO: 43 - protein, 4 aa, Artificial Sequence
  Synthetic Construct
SGGG

SEQ ID NO: 44 - protein, 11 aa, Artificial Sequence
  Synthetic Construct
GSSSGPPGPPS

SEQ ID NO: 45 - protein, 3 aa, Artificial Sequence
  Synthetic Construct
GGS

SEQ ID NO: 46 - protein, 8 aa, Artificial Sequence
  Synthetic Construct
GGGSSGGS

SEQ ID NO: 47 - protein, 5 aa, Artificial Sequence
  Synthetic Construct
GGSGG

SEQ ID NO: 48 - protein, 4 aa, Artificial Sequence
  Synthetic Construct
GGGS

SEQ ID NO: 49 - protein, 2 aa, Artificial Sequence
  Synthetic Construct
GS

SEQ ID NO: 50 - protein, 10 aa, Artificial Sequence
  Synthetic Construct
GSGGGSSGGS

SEQ ID NO: 51 - protein, 6 aa, Artificial Sequence
  Synthetic Construct
GSSGGS

SEQ ID NO: 52 - protein, 9 aa, Artificial Sequence
  Synthetic Construct
GGGSSGGSG

SEQ ID NO: 53 - protein, 7 aa, Artificial Sequence
  Synthetic Construct
GGSAGGS

SEQ ID NO: 54 - protein, 3 aa, Artificial Sequence
  Synthetic Construct
GHS

SEQ ID NO: 55 - protein, 3 aa, Artificial Sequence
  Synthetic Construct
GPS

SEQ ID NO: 56 - protein, 3 aa, Artificial Sequence
  Synthetic Construct
GAS

SEQ ID NO: 57 - protein, 3 aa, Artificial Sequence
  Synthetic Construct
SGG

SEQ ID NO: 58 - protein, 6 aa, Artificial Sequence
  Synthetic Construct
SGGSGG

SEQ ID NO: 59 - protein, 3 aa, Artificial Sequence
  Synthetic Construct
SSG

SEQ ID NO: 60 - protein, 6 aa, Artificial Sequence
  Synthetic Construct
GGGSGG

SEQ ID NO: 61 - protein, 2 aa, Artificial Sequence
  Synthetic Construct
GG

SEQ ID NO: 62 - protein, 3 aa, Artificial Sequence
  Synthetic Construct
GGG

SEQ ID NO: 63 - protein, 4 aa, Artificial Sequence
  Synthetic Construct
SHGG

SEQ ID NO: 64 - protein, 4 aa, Artificial Sequence
  Synthetic Construct
HGGG

SEQ ID NO: 65 - protein, 4 aa, Artificial Sequence
  Synthetic Construct
SGAA

SEQ ID NO: 66 - protein, 4 aa, Artificial Sequence
  Synthetic Construct
SGPA

SEQ ID NO: 67 - protein, 6 aa, Artificial Sequence
  Synthetic Construct
GGSGGS

SEQ ID NO: 68 - protein, 6 aa, Artificial Sequence
  Synthetic Construct
GGSGGP

SEQ ID NO: 69 - protein, 6 aa, Artificial Sequence
  Synthetic Construct
GGSGGG

SEQ ID NO: 70 - protein, 8 aa, Artificial Sequence
  Synthetic Construct
GSGGPGPS

SEQ ID NO: 71 - protein, 7 aa, Artificial Sequence
  Synthetic Construct
SGPPGSS

SEQ ID NO: 72 - protein, 7 aa, Artificial Sequence
  Synthetic Construct
SSGGSGP

SEQ ID NO: 73 - protein, 8 aa, Artificial Sequence
  Synthetic Construct
SSPSPSGG

SEQ ID NO: 74 - protein, 6 aa, Artificial Sequence
  Synthetic Construct
SPGGSS

SEQ ID NO: 75 - protein, 7 aa, Artificial Sequence
  Synthetic Construct
GGPGSSP

SEQ ID NO: 76 - protein, 9 aa, Artificial Sequence
  Synthetic Construct
SGPPGGPSS

SEQ ID NO: 77 - protein, 12 aa, Artificial Sequence
  Synthetic Construct
GPGPGSPPGGSS

SEQ ID NO: 78 - protein, 4 aa, Artificial Sequence
  Synthetic Construct
SGPP

SEQ ID NO: 79 - protein, 7 aa, Artificial Sequence
  Synthetic Construct
PGSPSSS

SEQ ID NO: 80 - protein, 7 aa, Artificial Sequence
  Synthetic Construct
PSPGGPS

SEQ ID NO: 81 - protein, 5 aa, Artificial Sequence
  Synthetic Construct
GGPPS

SEQ ID NO: 82 - protein, 6 aa, Artificial Sequence
  Synthetic Construct
PSPPSS

SEQ ID NO: 83 - protein, 6 aa, Artificial Sequence
  Synthetic Construct
SGGPGP

SEQ ID NO: 84 - protein, 6 aa, Artificial Sequence
  Synthetic Construct
GPSPGS

SEQ ID NO: 85 - protein, 7 aa, Artificial Sequence
  Synthetic Construct
GSPGPSP

SEQ ID NO: 86 - protein, 7 aa, Artificial Sequence
  Synthetic Construct
PSSGGSS

SEQ ID NO: 87 - protein, 6 aa, Artificial Sequence
  Synthetic Construct
SGSSGP

SEQ ID NO: 88 - protein, 7 aa, Artificial Sequence
  Synthetic Construct
GGSSSPP

SEQ ID NO: 89 - protein, 6 aa, Artificial Sequence
  Synthetic Construct
GSPGSP

SEQ ID NO: 90 - protein, 4 aa, Artificial Sequence
  Synthetic Construct
PPPS

SEQ ID NO: 91 - protein, 5 aa, Artificial Sequence
  Synthetic Construct
APPPS

SEQ ID NO: 92 - protein, 6 aa, Artificial Sequence
  Synthetic Construct
AAPPPS

SEQ ID NO: 93 - protein, 6 aa, Artificial Sequence
  Synthetic Construct
SAPPPS

SEQ ID NO: 94 - protein, 4 aa, Artificial Sequence
  Synthetic Construct
SSGP

SEQ ID NO: 95 - protein, 5 aa, Artificial Sequence
  Synthetic Construct
SSPGP

SEQ ID NO: 96 - protein, 8 aa, Artificial Sequence
  Synthetic Construct
MPYDLYHP

SEQ ID NO: 97 - protein, 8 aa, Artificial Sequence
  Synthetic Construct
GGIGQLTA

SEQ ID NO: 98 - protein, 8 aa, Artificial Sequence
  Synthetic Construct
DLGRFQTF

SEQ ID NO: 99 - protein, 8 aa, Artificial Sequence
  Synthetic Construct
DSGGFMLT

SEQ ID NO: 100 - protein, 8 aa, Artificial Sequence
  Synthetic Construct
TSVLMAAP

SEQ ID NO: 101 - protein, 10 aa, Artificial Sequence
  Synthetic Construct
TSEFVFAPDQ

SEQ ID NO: 102 - protein, 8 aa, Artificial Sequence
  Synthetic Construct
KLVLPVLP

SEQ ID NO: 103 - protein, 8 aa, Artificial Sequence
  Synthetic Construct
KPILFFRL

SEQ ID NO: 104 - protein, 6 aa, Artificial Sequence
  Synthetic Construct
ANQLKG

SEQ ID NO: 105 - protein, 6 aa, Artificial Sequence
  Synthetic Construct
QSQLKE

SEQ ID NO: 106 - protein, 6 aa, Artificial Sequence
  Synthetic Construct
HEQLTV

SEQ ID NO: 107 - protein, 9 aa, Artificial Sequence
  Synthetic Construct
PANLVAPDP

SEQ ID NO: 108 - protein, 9 aa, Artificial Sequence
  Synthetic Construct
PAPGVYPGP

SEQ ID NO: 109 - protein, 10 aa, Artificial Sequence
  Synthetic Construct
APAGLIVPYN

SEQ ID NO: 110 - protein, 6 aa, Artificial Sequence
  Synthetic Construct
PQALVA

SEQ ID NO: 111 - protein, 6 aa, Artificial Sequence
  Synthetic Construct
VGNLNF

SEQ ID NO: 112 - protein, 7 aa, Artificial Sequence
  Synthetic Construct
VANLLYE

SEQ ID NO: 113 - protein, 6 aa, Artificial Sequence
  Synthetic Construct
VYNLMD

SEQ ID NO: 114 - protein, 6 aa, Artificial Sequence
  Synthetic Construct
TFNIKQ

SEQ ID NO: 115 - protein, 7 aa, Artificial Sequence
  Synthetic Construct
DLWKLLP

SEQ ID NO: 116 - protein, 7 aa, Artificial Sequence
  Synthetic Construct
PGSTKRA

SEQ ID NO: 117 - protein, 8 aa, Artificial Sequence
  Synthetic Construct
QQYRALKS

SEQ ID NO: 118 - protein, 7 aa, Artificial Sequence
  Synthetic Construct
YVPRAVL

SEQ ID NO: 119 - protein, 7 aa, Artificial Sequence
  Synthetic Construct
GVNKWPT

SEQ ID NO: 120 - protein, 8 aa, Artificial Sequence
  Synthetic Construct
LAQAVRSS

SEQ ID NO: 121 - protein, 8 aa, Artificial Sequence
  Synthetic Construct
RAAAVKSP

SEQ ID NO: 122 - protein, 9 aa, Artificial Sequence
  Synthetic Construct
DLLAVVAAS

SEQ ID NO: 123 - protein, 8 aa, Artificial Sequence
  Synthetic Construct
VQTVTWPD

SEQ ID NO: 124 - protein, 8 aa, Artificial Sequence
  Synthetic Construct
AIPMSIPP

SEQ ID NO: 125 - protein, 8 aa, Artificial Sequence
  Synthetic Construct
GYEVHHQK

SEQ ID NO: 126 - protein, 8 aa, Artificial Sequence
  Synthetic Construct
VHHQKLVF

SEQ ID NO: 127 - protein, 8 aa, Artificial Sequence
  Synthetic Construct
IRRVSYSF

SEQ ID NO: 128 - protein, 14 aa, Artificial Sequence
  Synthetic Construct
MPYDLYHPILFFRL

SEQ ID NO: 129 - protein, 14 aa, Artificial Sequence
  Synthetic Construct
GGIGQLTSVLMAAP

SEQ ID NO: 130 - protein, 15 aa, Artificial Sequence
  Synthetic Construct
DSGGFMLTLVLPVLP

SEQ ID NO: 131 - protein, 16 aa, Artificial Sequence
  Synthetic Construct
TSEFVFAPDLGRFQTF

SEQ ID NO: 132 - protein, 11 aa, Artificial Sequence
  Synthetic Construct
TSTSGRSANPR

SEQ ID NO: 133 - protein, 11 aa, Artificial Sequence
  Synthetic Construct
TSTSGRSANPG

SEQ ID NO: 134 - protein, 11 aa, Artificial Sequence
  Synthetic Construct
TSTSGRSANPH

SEQ ID NO: 135 - protein, 6 aa, Artificial Sequence
  Synthetic Construct
VPLSLY

SEQ ID NO: 136 - protein, 11 aa, Artificial Sequence
  Synthetic Construct
TSASGASASAA

SEQ ID NO: 137 - protein, 10 aa, Artificial Sequence
  Synthetic Construct
PSSPGGGSSP

SEQ ID NO: 138 - protein, 13 aa, Artificial Sequence
  Synthetic Construct
ISSGLLSGRSDNH

SEQ ID NO: 139 - protein, 13 aa, Artificial Sequence
  Synthetic Construct
ISSGLLSGRSDDH

SEQ ID NO: 140 - protein, 13 aa, Artificial Sequence
  Synthetic Construct
ISSGLLSGRSDIH

SEQ ID NO: 141 - protein, 13 aa, Artificial Sequence
  Synthetic Construct
ISSGLLSGRSDQH

SEQ ID NO: 142 - protein, 13 aa, Artificial Sequence
  Synthetic Construct
ISSGLLSGRSDTH

SEQ ID NO: 143 - protein, 13 aa, Artificial Sequence
  Synthetic Construct
ISSGLLSGRSANP

SEQ ID NO: 144 - protein, 13 aa, Artificial Sequence
  Synthetic Construct
ISSGLLSGRSDNP

SEQ ID NO: 145 - protein, 15 aa, Artificial Sequence
  Synthetic Construct
ISSGLLSGRSANPRG

SEQ ID NO: 146 - protein, 18 aa, Artificial Sequence
  Synthetic Construct
AVGLLAPPGGLSGRSDNH

SEQ ID NO: 147 - protein, 18 aa, Artificial Sequence
  Synthetic Construct
AVGLLAPPGGLSGRSDDH

SEQ ID NO: 148 - protein, 18 aa, Artificial Sequence
  Synthetic Construct
AVGLLAPPGGLSGRSDIH

SEQ ID NO: 149 - protein, 18 aa, Artificial Sequence
  Synthetic Construct
AVGLLAPPGGLSGRSDQH

SEQ ID NO: 150 - protein, 18 aa, Artificial Sequence
  Synthetic Construct
AVGLLAPPGGLSGRSDTH

SEQ ID NO: 151 - protein, 18 aa, Artificial Sequence
  Synthetic Construct
AVGLLAPPGGLSGRSANP

SEQ ID NO: 152 - protein, 18 aa, Artificial Sequence
  Synthetic Construct
AVGLLAPPGGLSGRSDNP

SEQ ID NO: 153 - protein, 17 aa, Artificial Sequence
  Synthetic Construct
AVGLLAPPSGRSANPRG

SEQ ID NO: 154 - protein, 226 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 155 - protein, 226 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 156 - protein, 226 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 157 - protein, 213 aa, Artificial Sequence
  Synthetic Construct
EIVLTQSPDFQSVTPKEKVTITCSANSALSYMYWYQQKPDQSPKLWVHGTSNLASGVPSRFSGSGSGTDFTLTINSLEAEDAATYYCHHWSNTQWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 158 - protein, 449 aa, Artificial Sequence
  Synthetic Construct
QVQLVQSGAEVKKPGSSVKVSCKASGYTFTNYFMNWVRQAPGQGLEWMGRVDPEQGRADYAEKFKKRVTITADKSTSTAYMELSSLRSEDTAVYYCARRAMDNYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 159 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 160 - protein, 133 aa, Homo sapiens [sequence omitted]

SEQ ID NO: 161 - protein, 12 aa, Artificial Sequence
  Synthetic Construct
CGGHQYERRGGC

SEQ ID NO: 162 - protein, 12 aa, Artificial Sequence
  Synthetic Construct
CSGHQYERREGC

SEQ ID NO: 163 - protein, 12 aa, Artificial Sequence
  Synthetic Construct
CGGHYFERHGGC

SEQ ID NO: 164 - protein, 12 aa, Artificial Sequence
  Synthetic Construct
CSGHYFERHEGC

SEQ ID NO: 165 - protein, 12 aa, Artificial Sequence
  Synthetic Construct
CSFHQYERHEGC

SEQ ID NO: 166 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 167 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 168 - protein, 330 aa, Homo sapiens [sequence omitted]

SEQ ID NO: 169 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - protein, 585 aa, Homo sapiens
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQGLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVGSKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDCLSVFLNQLCVLHEKTPVSDRVTKCCTESLVNGRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 172 - protein, 46 aa, Streptococcus
  Synthetic Construct
LAEAKVLANRELDKYGVSDYYKNLINNAKTVEGVKALIDEILAALP

SEQ ID NO: 173 - protein, 11 aa, Artificial Sequence
  Synthetic Construct
DICLPRWGCLW

SEQ ID NO: 174 - protein, 18 aa, Artificial Sequence
  Synthetic Construct
RLIEDICLPRWGCLWEDD

SEQ ID NO: 175 - protein, 13 aa, Artificial Sequence
  Synthetic Construct
DCAWHLGELVWCT

SEQ ID NO: 176 - protein, 8 aa, Artificial Sequence
  Synthetic Construct
NKFRGKYK

SEQ ID NO: 177 - protein, 8 aa, Artificial Sequence
  Synthetic Construct
NARKFYKG

SEQ ID NO: 178 - protein, 8 aa, Artificial Sequence
  Synthetic Construct
FYWHCLDE

SEQ ID NO: 179 - protein, 8 aa, Artificial Sequence
  Synthetic Construct
FYCHWALE

SEQ ID NO: 180 - protein, 8 aa, Artificial Sequence
  Synthetic Construct
FYCHTIDE

SEQ ID NO: 181 - protein, 51 aa, Staphylococcus aureus
AQQNAFYQVLNMPNLNADQRNGFIQSLKDDPSQSANVLGEAQKLNDSQAPK

SEQ ID NO: 182 - protein, 61 aa, Staphylococcus aureus
ADAQQNKFNKDQQSAFYEILNMPNLNEEQRNGFIQSLKDDPSQSTNVLGEAKKLNESQAPK

SEQ ID NO: 183 - protein, 58 aa, Staphylococcus aureus
ADNNFNKEQQNAFYEILNMPNLNEEQRNGFIQSLKDDPSQSANLLAEAKKLNESQAPK

SEQ ID NO: 184 - protein, 58 aa, Staphylococcus aureus [sequence omitted]

SEQ ID NO: 185 - protein, 58 aa, Staphylococcus aureus
ADNKFNKEQQNAFYEILHLPNLTEEQRNGFIQSLKDDPSVSKEILAEAKKLNDAQAPK

SEQ ID NO: 186 - protein, 58 aa, Staphylococcus aureus [sequence omitted]

SEQ ID NO: 187 - protein, 122 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCAREDWLGEADYGMDVWGQGTTVTVSS

SEQ ID NO: 188 - protein, 112 aa, Artificial Sequence
  Synthetic Construct
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPTFGQGTKVEIKR

SEQ ID NO: 189 - protein, 119 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARDGEQWRGFDYWGQGTTVTVSS

SEQ ID NO: 190 - protein, 112 aa, Artificial Sequence; identical to SEQ ID NO: 188
  Synthetic Construct

SEQ ID NO: 191 - protein, 120 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARDQEQWRLAFDYWGQGTTVTVSS

SEQ ID NO: 192 - protein, 112 aa, Artificial Sequence; identical to SEQ ID NO: 188
  Synthetic Construct

SEQ ID NO: 193 - protein, 126 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARGAVAGTGRDYYYYGMDVWGQGTTVTVSS

SEQ ID NO: 194 - protein, 114 aa, Artificial Sequence
  Synthetic Construct
DIVMTQSPLSLPVTPGEPASISCRSSQSLLHSNGYNYLDWYLQKPGQSPQLLIYLGSNRASGVPDRFSGSGSGTDFTLKLISRVEAEDVGVYYCMQALQTPLTFGGGTKVEIKR

SEQ ID NO: 195 - protein, 126 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARGSYYDSSGYYYGEDFDYWGQGTTVTVSS

SEQ ID NO: 196 - protein, 112 aa, Artificial Sequence
  Synthetic Construct
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQTSQFPTFGQGTKVEIKR

SEQ ID NO: 197 - protein, 121 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCAREEWELEDYGMDVWGQGTTVTVSS

SEQ ID NO: 198 - protein, 112 aa, Artificial Sequence
  Synthetic Construct
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQTTQFPTFGQGTKVEIKR

SEQ ID NO: 199 - protein, 120 aa, Artificial Sequence
  Synthetic Construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREDFDSHYGMDVWGQGTTVTVSS

SEQ ID NO: 200 - protein, 112 aa, Artificial Sequence; identical to SEQ ID NO: 198
  Synthetic Construct

SEQ ID NO: 201 - protein, 119 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARDNWGSDAFDIWGQGTTVTVSS

SEQ ID NO: 202 - protein, 112 aa, Artificial Sequence
  Synthetic Construct
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQVTQFPTFGQGTKVEIKR

SEQ ID NO: 203 - protein, 122 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARDDWFGEADYGMDVWGQGTTVTVSS

SEQ ID NO: 204 - protein, 112 aa, Artificial Sequence; identical to SEQ ID NO: 198
  Synthetic Construct

SEQ ID NO: 205 - protein, 118 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARRISITPFDYWGQGTTVTVSS

SEQ ID NO: 206 - protein, 109 aa, Artificial Sequence
  Synthetic Construct
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKR

SEQ ID NO: 207 - protein, 118 aa, Artificial Sequence
  Synthetic Construct
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQQVAGMLDYWGQGTTVTVSS

SEQ ID NO: 208 - protein, 109 aa, Artificial Sequence; identical to SEQ ID NO: 206
  Synthetic Construct

SEQ ID NO: 209 - protein, 120 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARDDFWSDYPFDYWGQGTTVTVSS

SEQ ID NO: 210 - protein, 112 aa, Artificial Sequence; identical to SEQ ID NO: 198
  Synthetic Construct

SEQ ID NO: 211 - protein, 122 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCAREEWFGEADYGMDVWGQGTTVTVSS

SEQ ID NO: 212 - protein, 112 aa, Artificial Sequence; identical to SEQ ID NO: 198
  Synthetic Construct

SEQ ID NO: 213 - protein, 126 aa, Artificial Sequence; identical to SEQ ID NO: 193
  Synthetic Construct

SEQ ID NO: 214 - protein, 114 aa, Artificial Sequence; identical to SEQ ID NO: 194
  Synthetic Construct

SEQ ID NO: 215 - protein, 126 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARGSYYDSSGYYFGEDFDYWGQGTTVTVSS

SEQ ID NO: 216 - protein, 112 aa, Artificial Sequence; identical to SEQ ID NO: 202
  Synthetic Construct

SEQ ID NO: 217 - protein, 126 aa, Artificial Sequence
  Synthetic Construct
QVQLVESGGGVVQPGRSLRLSCAASGFTFSIYGMHWVRQAPGKGLEWVTVIWYDGSNEYYADSVKGRFTISRDNSKNTLYLQMNSLRAEDTAVYYCARGTVAGTGRDYYYYGMDVWGQGTTVTVSS

SEQ ID NO: 218 - protein, 114 aa, Artificial Sequence; identical to SEQ ID NO: 194
  Synthetic Construct

SEQ ID NO: 219 - protein, 108 aa, Artificial Sequence
  Synthetic Construct
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSHTFGQGTKLEISR

SEQ ID NO: 220 - protein, 118 aa, Artificial Sequence
  Synthetic Construct
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGGNWNCFDYWGQGTLVTVSS

SEQ ID NO: 221 - protein, 201 aa, Homo sapiens
GMLSLAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQAFRTLTGH

SEQ ID NO: 222 - protein, 8 aa, Homo sapiens
QKLTTVDI

SEQ ID NO: 223 - protein, 10 aa, Homo sapiens
CQKLTTVDIC

SEQ ID NO: 224 - protein, 6 aa, Homo sapiens
SHYFER

SEQ ID NO: 225 - protein, 8 aa, Homo sapiens
CSHYFERC

SEQ ID NO: 226 - protein, 98 aa, Homo sapiens
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDF

SEQ ID NO: 227 - protein, 241 aa, Homo sapiens
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAV

SEQ ID NO: 228 - protein, 197 aa, Homo sapiens
TLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNT

SEQ ID NO: 229 - protein, 100 aa, Homo sapiens
TLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVI

SEQ ID NO: 230 - protein, 130 aa, Homo sapiens
SSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 231 - protein, 212 aa, Homo sapiens
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETS

SEQ ID NO: 232 - protein, 77 aa, Homo sapiens
ITCPPPMSVEHADIWVKSYSLYSRERYICNSGFKRKAGTSSLTECVLNKATNVAHWTTPSLKCIRDPALVHQRPAPP

SEQ ID NO: 233 - protein, 67 aa, Homo sapiens
ITCPPPMSVEHADIWVKSYSLYSRERYICNSGFKRKAGTSSLTECVLNKATNVAHWTTPSLKCIRDP

SEQ ID NO: 234 - protein, 65 aa, Homo sapiens
ITCPPPMSVEHADIWVKSYSLYSRERYICNSGFKRKAGTSSLTECVLNKATNVAHWTTPSLKCIR

SEQ ID NO: 235 - protein, 20 aa, Artificial Sequence
  Synthetic Construct
SGGSGGGGSGGGSGGGGSLQ

SEQ ID NO: 236 - protein, 5 aa, Artificial Sequence
  Synthetic Construct
SGRSA

SEQ ID NO: 237 - protein, 7 aa, Artificial Sequence
  Synthetic Construct
SGRSANA

SEQ ID NO: 238 - protein, 6 aa, Artificial Sequence
  Synthetic Construct
SGRNAQ

SEQ ID NO: 239 - protein, 8 aa, Artificial Sequence
  Synthetic Construct
SGRNAQVR

SEQ ID NO: 240 - protein, 6 aa, Artificial Sequence
  Synthetic Construct
SGRSDN

SEQ ID NO: 241 - protein, 8 aa, Artificial Sequence
  Synthetic Construct
SGRSDNPN

SEQ ID NO: 242 - protein, 6 aa, Artificial Sequence
  Synthetic Construct
GSGKSA

SEQ ID NO: 243 - protein, 133 aa, Artificial Sequence
  Synthetic Construct
APASSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 244 - protein, 133 aa, Artificial Sequence
  Synthetic Construct
APASSSTKKTQLQLEHLLLDLQMILNGINNYKNPKLTRMLTFKFYMPKKATELKHLQCLEEELKPLEEVLNLAQSKNFHFDPRDVVSNINVFVLELKGSETTFMCEYADETATIVEFLNRWITFAQSIISTLT

SEQ ID NO: 245 - protein, 133 aa, Artificial Sequence
  Synthetic Construct
APASSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 246 - protein, 133 aa, Artificial Sequence
  Synthetic Construct
APASSSTKKTQLQLEHLLLDLQMILNGINNYKNPKLTRMLTKKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 247 - protein, 133 aa, Artificial Sequence
  Synthetic Construct
APASSSTKKTQLQLEHLLLDLQMILNGINNYKNPKLTRMLTFAFAMPKKATELKHLQCLEEELKPLEEVLNGAQSKNFHLRPRDLISNINVIVLELKGSETTFMCEYADETATIVEFLNRWITFAQSIISTLT

SEQ ID NO: 248 - protein, 133 aa, Artificial Sequence
  Synthetic Construct
APASSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLT

SEQ ID NO: 249 - protein, 133 aa, Artificial Sequence
  Synthetic Construct
APASSSTKKTQLQLEHLLLDLQMILNGINNYKNPKLTRMLTKKFYMPKKATELKHLQCLEEELKPLEEVLNLAQSKNFHFDPRDVVSNINVFVLELKGSETTFMCEYADETATIVEFLNRWITFAQSIISTLT

SEQ ID NO: 250 - protein, 133 aa, Artificial Sequence
  Synthetic Construct
APASSSTKKTQLQLEHLLLDLQMILNGINNYKNPKLTRMLTAKFAMPKKATELKHLQCLEEELKPLEEVLNGAQSKNFHFDPRDVVSNINVFVLELKGSETTFMCEYADETATIVEFLNRWITFAQSIISTLT

SEQ ID NO: 251 - protein, 133 aa, Artificial Sequence
  Synthetic Construct
APASSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 252 - protein, 115 aa, Artificial Sequence [sequence omitted]

SEQ ID NO: 253 - protein, 115 aa, Artificial Sequence [sequence omitted]

SEQ ID NO: 254 - protein, 115 aa, Artificial Sequence [sequence omitted]

SEQ ID NO: 255 - protein, 115 aa, Artificial Sequence [sequence omitted]

SEQ ID NO: 256 - protein, 115 aa, Artificial Sequence [sequence omitted]

SEQ ID NO: 257 - protein, 115 aa, Artificial Sequence
  Synthetic Construct
EVQLVESGGGLVQPGNSLRLSCAASGFTFSSFGMSWVRQAPGKGLEWVSSISGSGSDTLYADSVKGRETISRDNAKTTLYLQMNSLRPEDTAVYYCTIGGSLSRSSQGTLVTVSS

SEQ ID NO: 258 - protein, 115 aa, Artificial Sequence
  Synthetic Construct
EVQLVESGGGLVQPGNSLRLSCAASGFTFSSFGMSWVRQAPGKGLEWVSSISGSGSDTLYADSVKGRETISRDNAKNTLYLQMNSLRPEDTAVYYCTIGGSLSRSSQGTLVTVSS

SEQ ID NO: 259 - protein, 115 aa, Artificial Sequence [sequence omitted]

SEQ ID NO: 260 - protein, 131 aa, Artificial Sequence
  Synthetic Construct
TSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 261 - protein, 213 aa, Artificial Sequence
  Synthetic Construct
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 262 - protein, 17 aa, Homo sapiens
GSGPDSGGFMLTSGPAP

SEQ ID NO: 263 - protein, 17 aa, Artificial Sequence
  Synthetic Construct
GSSPPGDSGGFMLTSGP

SEQ ID NO: 264 - protein, 9 aa, Artificial Sequence
  Synthetic Construct
DSGGFMLTS

SEQ ID NO: 265 - protein, 227 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 266 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGPDSGGFMLTSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 267 - protein, 444 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 268 - protein, 4 aa, Artificial Sequence
  Synthetic Construct
GSGP

SEQ ID NO: 269 - protein, 4 aa, Artificial Sequence
  Synthetic Construct
GPAP

SEQ ID NO: 270 - protein, 16 aa, Artificial Sequence
  Synthetic Construct
ISSGLLGGLSGRSDQP

SEQ ID NO: 271 - protein, 13 aa, Artificial Sequence
  Synthetic Construct
ISSGLLSGRSDQG

SEQ ID NO: 272 - protein, 13 aa, Artificial Sequence
  Synthetic Construct
ISSGLLSGRSDQA

SEQ ID NO: 273 - protein, 13 aa, Artificial Sequence
  Synthetic Construct
ISSGLLSGRSDSP

SEQ ID NO: 274 - protein, 13 aa, Artificial Sequence
  Synthetic Construct
ISSGLLSGRSDTP

SEQ ID NO: 275 - protein, 13 aa, Artificial Sequence
  Synthetic Construct
ISSGLLSGRSDMP

SEQ ID NO: 276 - protein, 11 aa, Artificial Sequence
  Synthetic Construct
ISSGLLSGRSD

SEQ ID NO: 277 - protein, 13 aa, Artificial Sequence
  Synthetic Sequence
ISSGLLSGRSDQP

SEQ ID NO: 278 - protein, 16 aa, Artificial Sequence
  Synthetic Construct
ISSGLLGGLSGRSDNP

SEQ ID NO: 279 - protein, 18 aa, Artificial Sequence
  Synthetic Construct
ISSGLLSSGGLSGRSDQP

SEQ ID NO: 280 - protein, 18 aa, Artificial Sequence
  Synthetic Construct
ISSGLLSSGGLSGRSDNP

SEQ ID NO: 281 - protein, 10 aa, Artificial Sequence
  Synthetic Construct
ISSGLLSGRS

SEQ ID NO: 282 - protein, 13 aa, Artificial Sequence
  Synthetic Construct
ISSGLLSGRSESP

SEQ ID NO: 283 - protein, 13 aa, Artificial Sequence
  Synthetic Construct
ISSGLLSGRSEQP

SEQ ID NO: 284 - protein, 13 aa, Artificial Sequence
  Synthetic Construct
ISSGLLSGRSEQH

SEQ ID NO: 285 - protein, 13 aa, Artificial Sequence
  Synthetic Construct
LSSGLLSGRSDQP

SEQ ID NO: 286 - protein, 16 aa, Artificial Sequence
  Synthetic Construct
LSSGLLGGLSGRSDQP

SEQ ID NO: 287 - protein, 13 aa, Artificial Sequence
  Synthetic Construct
LSSGLLSGRSDQG

SEQ ID NO: 288 - protein, 13 aa, Artificial Sequence
  Synthetic Construct
LSSGLLSGRSDQA

SEQ ID NO: 289 - protein, 13 aa, Artificial Sequence
  Synthetic Construct
LSSGLLSGRSDSP

SEQ ID NO: 290 - protein, 13 aa, Artificial Sequence
  Synthetic Construct
LSSGLLSGRSDTP

SEQ ID NO: 291 - protein, 13 aa, Artificial Sequence
  Synthetic Construct
LSSGLLSGRSDMP

SEQ ID NO: 292 - protein, 11 aa, Artificial Sequence
  Synthetic Construct
LSSGLLSGRSD

SEQ ID NO: 293 - protein, 19 aa, Artificial Sequence
  Synthetic Construct
GKQLRVVNEYSSMDNMLLG

SEQ ID NO: 294 - protein, 16 aa, Artificial Sequence
  Synthetic Construct
LSSGLLGGLSGRSDNP

SEQ ID NO: 295 - protein, 18 aa, Artificial Sequence
  Synthetic Construct
LSSGLLSSGGLSGRSDQP

SEQ ID NO: 296 - protein, 18 aa, Artificial Sequence
  Synthetic Construct
LSSGLLSSGGLSGRSDNP

SEQ ID NO: 297 - protein, 19 aa, Artificial Sequence
  Synthetic Construct
GKQLRVVNEYSSEDNMLLG

SEQ ID NO: 298 - protein, 13 aa, Artificial Sequence
  Synthetic Construct
LSSGLLSGRSESP

SEQ ID NO: 299 - protein, 13 aa, Artificial Sequence
  Synthetic Construct
LSSGLLSGRSEQP

SEQ ID NO: 300 - protein, 13 aa, Artificial Sequence
  Synthetic Construct
LSSGLLSGRSEQH

SEQ ID NO: 301 - protein, 7 aa, Artificial Sequence
  Synthetic Construct
MPYDLYH

SEQ ID NO: 302 - protein, 8 aa, Artificial Sequence
  Synthetic Construct
LSGRSDNH

SEQ ID NO: 303 - protein, 6 aa, Artificial Sequence
  Synthetic Construct
GGGSSP

SEQ ID NO: 304 - protein, 4 aa, Artificial Sequence
  Synthetic Construct
SGGP

SEQ ID NO: 305 - protein, 8 aa, Artificial Sequence
  Synthetic Construct
SGPSGSPG

SEQ ID NO: 306 - protein, 10 aa, Artificial Sequence
  Synthetic Construct
GSIPVSLRSG

SEQ ID NO: 307 - protein, 13 aa, Artificial Sequence
  Synthetic Construct
GPSGPAGLKGAPG

SEQ ID NO: 308 - protein, 13 aa, Artificial Sequence
  Synthetic Construct
GPPGPAGMKGLPG

SEQ ID NO: 309 - protein, 8 aa, Artificial Sequence
  Synthetic Construct
GYVADAPK

SEQ ID NO: 310 - protein, 8 aa, Artificial Sequence
  Synthetic Construct
KKLADEPE

SEQ ID NO: 311 - protein, 13 aa, Artificial Sequence
  Synthetic Construct
GGSRPAHLRDSGK

SEQ ID NO: 312 - protein, 10 aa, Artificial Sequence
  Synthetic Construct
SFTQARVVGG

SEQ ID NO: 313 - protein, 17 aa, Artificial Sequence
  Synthetic Construct
VHMPLGFLGPRQARVVN

SEQ ID NO: 314 - protein, 16 aa, Artificial Sequence
  Synthetic Construct
LSGRSDNHSPLGLAGS

SEQ ID NO: 315 - protein, 8 aa, Artificial Sequence
  Synthetic Construct
VPLSLYSG

SEQ ID NO: 316 - protein, 8 aa, Artificial Sequence
  Synthetic Construct
IPESLRAG

SEQ ID NO: 317 - protein, 8 aa, Artificial Sequence
  Synthetic Construct
IPVSLRSG

SEQ ID NO: 318 - protein, 17 aa, Artificial Sequence
  Synthetic Construct
SGSGGSPVPLSLYSGGP

SEQ ID NO: 319 - protein, 16 aa, Artificial Sequence
  Synthetic Construct
GGGSSPVPLSLYSGGP

SEQ ID NO: 320 - protein, 20 aa, Artificial Sequence
  Synthetic Construct
GGSSPPVPLSLYSGPSGSPG

SEQ ID NO: 321 - protein, 20 aa, Artificial Sequence
  Synthetic Construct
GGSGGGSGGGSGGGSGGGSG

SEQ ID NO: 322 - protein, 24 aa, Artificial Sequence
  Synthetic Construct
GGSGGGSGGGSGGGSGGGSGGGSG

SEQ ID NO: 323 - protein, 5 aa, Artificial Sequence
  Synthetic Construct
PGPGP

SEQ ID NO: 324 - protein, 15 aa, Artificial Sequence
  Synthetic Construct
SGGCGGHQYERRGGC

SEQ ID NO: 325 - protein, 15 aa, Artificial Sequence
  Synthetic Construct
SGGCSGHQYERREGC

SEQ ID NO: 326 - protein, 15 aa, Artificial Sequence
  Synthetic Construct
SGGCGGHYFERHGGC

SEQ ID NO: 327 - protein, 15 aa, Artificial Sequence
  Synthetic Construct
SGGCSGHYFERHEGC

SEQ ID NO: 328 - protein, 15 aa, Artificial Sequence
  Synthetic Construct
SGGCSFHQYERHEGC

SEQ ID NO: 329 - protein, 5 aa, Artificial Sequence
  Synthetic Construct
PSGSS

SEQ ID NO: 330 - protein, 4 aa, Artificial Sequence
  Synthetic Construct
GSPG

SEQ ID NO: 331 - protein, 6 aa, Artificial Sequence
  Synthetic Construct
GGSPGG

SEQ ID NO: 332 - protein, 6 aa, Artificial Sequence
  Synthetic Construct
GGPGGP

SEQ ID NO: 333 - protein, 4 aa, Artificial Sequence
  Synthetic Construct
GGSG

SEQ ID NO: 334 - protein, 6 aa, Artificial Sequence
  Synthetic Construct
GSPPGG

SEQ ID NO: 335 - protein, 6 aa, Artificial Sequence
  Synthetic Construct
GPGSPG

SEQ ID NO: 336 - protein, 6 aa, Artificial Sequence
  Synthetic Construct
GSSPPG

SEQ ID NO: 337 - protein, 3 aa, Artificial Sequence
  Synthetic Construct
GGP

SEQ ID NO: 338 - protein, 7 aa, Artificial Sequence
  Synthetic Construct
SGPGSGS

SEQ ID NO: 339 - protein, 17 aa, Artificial Sequence
  Synthetic Construct
GGSSPPGGGSSGGGSGP

SEQ ID NO: 340 - protein, 7 aa, Artificial Sequence
  Synthetic Construct
SGPGSGS

SEQ ID NO: 341 - protein, 7 aa, Artificial Sequence
  Synthetic Construct
SGSGGSP

SEQ ID NO: 342 - protein, 6 aa, Artificial Sequence
  Synthetic Construct
IYDQKT

SEQ ID NO: 343 - protein, 6 aa, Artificial Sequence
  Synthetic Construct
AHNYKT

SEQ ID NO: 344 - protein, 6 aa, Artificial Sequence
  Synthetic Construct
MMDQAN

SEQ ID NO: 345 - protein, 8 aa, Artificial Sequence
  Synthetic Construct
MLGEFVSE

SEQ ID NO: 346 - protein, 8 aa, Artificial Sequence
  Synthetic Construct
GLVALRGA

SEQ ID NO: 347 - protein, 8 aa, Artificial Sequence
  Synthetic Construct
KEHKYKAE

SEQ ID NO: 348 - protein, 21 aa, Artificial Sequence
  Synthetic Construct
GGSSPPGGGSSGGGSGPGSGS

SEQ ID NO: 349 - protein, 19 aa, Artificial Sequence
  Synthetic Construct
GGSSPPVPLSLYSGPGSGS

SEQ ID NO: 350 - protein, 21 aa, Artificial Sequence
  Synthetic Construct
GNPMGSEPVNFKQLRVVNGGP

SEQ ID NO: 351 - protein, 21 aa, Artificial Sequence
  Synthetic Construct
GNPMGSEPVNFKLLRVVNGGP

SEQ ID NO: 352 - protein, 21 aa, Artificial Sequence
  Synthetic Construct
GNPMGSDPVNFKQLRVVNGGP

SEQ ID NO: 353 - protein, 21 aa, Artificial Sequence
  Synthetic Construct
GNPMGSDPVNFKLLRVVNGGP

SEQ ID NO: 354 - protein, 22 aa, Artificial Sequence
  Synthetic Construct
GGSSPPMPYDLYHPSGPSGSPG

SEQ ID NO: 355 - protein, 22 aa, Artificial Sequence
  Synthetic Construct
GGSSPPGGGSSGGGSGPSGSPG

SEQ ID NO: 356 - protein, 7 aa, Artificial Sequence
  Synthetic Construct
RQARVVG

SEQ ID NO: 357 - protein, 14 aa, Artificial Sequence
  Synthetic Construct
LGGSGRSNAQVRLE

SEQ ID NO: 358 - protein, 13 aa, Artificial Sequence
  Synthetic Construct
LGGSGRKASLSLE

SEQ ID NO: 359 - protein, 10 aa, Artificial Sequence
  Synthetic Construct
SGRIGFLRTA

SEQ ID NO: 360 - protein, 10 aa, Artificial Sequence
  Synthetic Construct
SGAIGFLRTA

SEQ ID NO: 361 - protein, 14 aa, Artificial Sequence
  Synthetic Construct
RPARSGRSAGGSVA

SEQ ID NO: 362 - protein, 11 aa, Artificial Sequence
  Synthetic Construct
VTGRGDSPASS

SEQ ID NO: 363 - protein, 8 aa, Artificial Sequence
  Synthetic Construct
PRFKIIGG

SEQ ID NO: 364 - protein, 11 aa, Artificial Sequence
  Synthetic Construct
LSGRIGFLRTA

SEQ ID NO: 365 - protein, 15 aa, Artificial Sequence
  Synthetic Construct
LSGRSNAMPYDLYHP

SEQ ID NO: 366 - protein, 15 aa, Artificial Sequence
  Synthetic Construct
LSGRSNAGGIGQLTA

SEQ ID NO: 367 - protein, 13 aa, Artificial Sequence
  Synthetic Construct
LSGRSNAVPLSLY

SEQ ID NO: 368 - protein, 15 aa, Artificial Sequence
  Synthetic Construct
LSGRSNADSGGFMLT

SEQ ID NO: 369 - protein, 13 aa, Artificial Sequence
  Synthetic Construct
LSGRSNAHEQLTA

SEQ ID NO: 370 - protein, 15 aa, Artificial Sequence
  Synthetic Construct
LSGRSNARAAAVKSP

SEQ ID NO: 371 - protein, 15 aa, Artificial Sequence
  Synthetic Construct
LSGRSNATSVLMAAP

SEQ ID NO: 372 - protein, 13 aa, Artificial Sequence
  Synthetic Construct
VPLSLYLSGRSNA

SEQ ID NO: 373 - protein, 15 aa, Artificial Sequence
  Synthetic Construct
DSGGFMLTLSGRSNA

SEQ ID NO: 374 - protein, 15 aa, Artificial Sequence
  Synthetic Construct
GGIGQLTALSGRSNA

SEQ ID NO: 375 - protein, 15 aa, Artificial Sequence
  Synthetic Construct
MPYDLYHPLSGRSNA

SEQ ID NO: 376 - protein, 13 aa, Artificial Sequence
  Synthetic Construct
HEQLTVLSGRSNA

SEQ ID NO: 377 - protein, 15 aa, Artificial Sequence
  Synthetic Construct
RAAAVKSPLSGRSNA

SEQ ID NO: 378 - protein, 15 aa, Artificial Sequence
  Synthetic Construct
TSVLMAAPLSGRSNA

SEQ ID NO: 379 - protein, 16 aa, Artificial Sequence
  Synthetic Construct
IPVSLRSGRSNAQRLE

SEQ ID NO: 380 - protein, 13 aa, Artificial Sequence
  Synthetic Construct
VPLSLYRQARVVG

SEQ ID NO: 381 - protein, 15 aa, DSGGFMLTRQARVVG
  Synthetic Construct
DSGGFMLTRQARVVG

SEQ ID NO: 382 - protein, 15 aa, Artificial Sequence
  Synthetic Construct
GGIGQLTARQARVVG

SEQ ID NO: 383 - protein, 15 aa, Artificial Sequence
  Synthetic Construct
MPYDLYHPRQARVVG

SEQ ID NO: 384 - protein, 13 aa, Artificial Sequence
  Synthetic Construct
HEQLTVRQARVVG

SEQ ID NO: 385 - protein, 15 aa, Artificial Sequence
  Synthetic Construct
RAAAVKSPRQARVVG

SEQ ID NO: 386 - protein, 15 aa, Artificial Sequence
  Synthetic Construct
TSVLMAAPRQARVVG

SEQ ID NO: 387 - protein, 18 aa, Artificial Sequence
  Synthetic Construct
KQLRVVNEYSSMDNMLLG

SEQ ID NO: 388 - protein, 18 aa, Artificial Sequence
  Synthetic Construct
KQLRVVNEYSSEDNMLLG

SEQ ID NO: 389 - protein, 18 aa, Artificial Sequence
  Synthetic Construct
KQLRVVNGYSSEDNMLLG

SEQ ID NO: 390 - protein, 18 aa, Artificial Sequence
  Synthetic Construct
KQLRVVGGLVHLKNTMET

SEQ ID NO: 391 - protein, 18 aa, Artificial Sequence
  Synthetic Construct
TRDRLDEVNFKQLRVVNG

SEQ ID NO: 392 - protein, 18 aa, Artificial Sequence
  Synthetic Construct
TRDRLDEVNFKLLRVVNG

SEQ ID NO: 393 - protein, 18 aa, Artificial Sequence
  Synthetic Construct
TRDRLDPVNFKQLRVVNG

SEQ ID NO: 394 - protein, 18 aa, Artificial Sequence
  Synthetic Construct
TRDRLDPVNFKLLRVVNG

SEQ ID NO: 395 - protein, 18 aa, Artificial Sequence
  Synthetic Construct
NPMGSEPVNFKQLRVVNG

SEQ ID NO: 396 - protein, 18 aa, Artificial Sequence
  Synthetic Construct
NPMGSEPVNFKLLRVVNG

SEQ ID NO: 397 - protein, 18 aa, Artificial Sequence
  Synthetic Construct
NPMGSDPVNFKQLRVVNG

SEQ ID NO: 398 - protein, 18 aa, Artificial Sequence
  Synthetic Construct
NPMGSDPVNFKLLRVVNG

SEQ ID NO: 399 - protein, 11 aa, Artificial Sequence
  Synthetic Construct
TYSRSKYLATA

SEQ ID NO: 400 - protein, 11 aa, Artificial Sequence
  Synthetic Construct
TYSRSRYLATA

SEQ ID NO: 401 - protein, 12 aa, Artificial Sequence
  Synthetic Construct
KQLRVVNEYSSE

SEQ ID NO: 402 - protein, 12 aa, Artificial Sequence
  Synthetic Construct
KQLRVVNGYSSE

SEQ ID NO: 403 - protein, 12 aa, Artificial Sequence
  Synthetic Construct
KQLRVVGGLVAL

SEQ ID NO: 404 - protein, 12 aa, Artificial Sequence
  Synthetic Construct
KQLRVVNGLVAL

SEQ ID NO: 405 - protein, 12 aa, Artificial Sequence
  Synthetic Construct
SPGRVVGGLVAL

SEQ ID NO: 406 - protein, 12 aa, Artificial Sequence
  Synthetic Construct
PQPRTYSRSRYL

SEQ ID NO: 407 - protein, 12 aa, Artificial Sequence
  Synthetic Construct
PQPRTTSRSRYL

SEQ ID NO: 408 - protein, 13 aa, Artificial Sequence
  Synthetic Construct
VVNEYSSSRGPYH

SEQ ID NO: 409 - protein, 13 aa, Artificial Sequence
  Synthetic Construct
VVNEYSSERGPYH

SEQ ID NO: 410 - protein, 13 aa, Artificial Sequence
  Synthetic Construct
NKVSMSSSRGPYH

SEQ ID NO: 411 - protein, 13 aa, Artificial Sequence
  Synthetic Construct
NKVSMSSTRGPYH

SEQ ID NO: 412 - protein, 13 aa, Artificial Sequence
  Synthetic Construct
APAMMRGSVILTV

SEQ ID NO: 413 - protein, 13 aa, Artificial Sequence
  Synthetic Constuct
APAMMEGSVILTV

SEQ ID NO: 414 - protein, 13 aa, Artificial Sequence
  Synthetic Construct
RGSVIITVQTVTW

SEQ ID NO: 415 - protein, 13 aa, Artificial Sequence
  Synthetic Construct
RGSVILTVQTVTW

SEQ ID NO: 416 - protein, 21 aa, Artificial Sequence
  Synthetic Construct
GTRDRLDEVNFKQLRVVNGGP

SEQ ID NO: 417 - protein, 21 aa, Artificial Sequence
  Synthetic Construct
GTRDRLDEVNFKLLRVVNGGP

SEQ ID NO: 418 - protein, 21 aa, Artificial Sequence
  Synthetic Construct
GTRDRLDPVNFKQLRVVNGGP

SEQ ID NO: 419 - protein, 21 aa, Artificial Sequence
  Synthetic Construct
GTRDRLDPVNFKLLRVVNGGP

SEQ ID NO: 420 - protein, 12 aa, Artificial Sequence
  Synthetic Construct
RKGKALAAYRLE

SEQ ID NO: 421 - protein, 12 aa, Artificial Sequence
  Synthetic Construct
RKGKAGAAYRLE

SEQ ID NO: 422 - protein, 12 aa, Artificial Sequence
  Synthetic Construct
RQARVVGGLVAL

SEQ ID NO: 423 - protein, 13 aa, Artificial Sequence
  Synthetic Construct
GGVRGPRFKIIGG

SEQ ID NO: 424 - protein, 13 aa, Artificial Sequence
  Synthetic Construct
GGVRGPRVKIIGG

SEQ ID NO: 425 - protein, 13 aa, Artificial Sequence
  Synthetic Construct
VTGRGDSHSLTTN

SEQ ID NO: 426 - protein, 13 aa, Artificial Sequence
  Synthetic Construct
VTGRGDSPSLTTN

SEQ ID NO: 427 - protein, 13 aa, `Artificial Sequence
  Synthetic Construct
TGHGQASQGLLDR

SEQ ID NO: 428 - protein, 13 aa, Artificial Sequence
  Synthetic Construct
TGHGQASSGLLDR

SEQ ID NO: 429 - protein, 13 aa, Artificial Sequence
  Synthetic Construct
KQLRVVNENLENY

SEQ ID NO: 430 - protein, 13 aa, Artificial Sequence
  Synthetic Construct
KQLRVVNGNLENY

SEQ ID NO: 431 - protein, 12 aa, Artificial Sequence
  Synthetic Construct
SNVNDVANYNFF

SEQ ID NO: 432 - protein, 12 aa, Artificial Sequence
  Synthetic Construct
SNVNDVSNYNFF

SEQ ID NO: 433 - protein, 12 aa, Artificial Sequence
  Synthetic Construct
IDFNAAQNLYEK

SEQ ID NO: 434 - protein, 12 aa, Artificial Sequence
  Synthetic Construct
IDFNAAYNLYEK

SEQ ID NO: 435 - protein, 12 aa, Artificial Sequence
  Synthetic Construct
IQWNAGQPLQER

SEQ ID NO: 436 - protein, 12 aa, Artificial Sequence
  Synthetic Construct
IQWNAPQPLQER

SEQ ID NO: 437 - protein, 12 aa, Artificial Sequence
  Synthetic Construct
SMDNRLLGLFGE

SEQ ID NO: 438 - protein, 12 aa, Artificial Sequence
  Synthetic Construct
SMDNMLLGLFGE

SEQ ID NO: 439 - protein, 12 aa, Artificial Sequence
  Synthetic Construct
VPIDDPQDLLEG

SEQ ID NO: 440 - protein, 12 aa, Artificial Sequence
  Synthetic Construct
VPIDDPEDLLEG

SEQ ID NO: 441 - protein, 12 aa, Artificial Sequence
  Synthetic Construct
IPENLPPGLPLT

SEQ ID NO: 442 - protein, 12 aa, Artificial Sequence
  Synthetic Construct
IPENLPPLLPLT

SEQ ID NO: 443 - protein, 12 aa, Artificial Sequence
  Synthetic Construct
QPPSLTKNQVSL

SEQ ID NO: 444 - protein, 12 aa, Artificial Sequence
  Synthetic Construct
QPPSLTRNQVSL

SEQ ID NO: 445 - protein, 12 aa, Artificial Sequence
  Synthetic Construct
DSHSLTKNQVSL

SEQ ID NO: 446 - protein, 12 aa, Artificial Sequence
  Synthetic Construct
DSHSLTTNQVSL

SEQ ID NO: 447 - protein, 12 aa, Artificial Sequence
  Synthetic Construct
KAIQLTKNQVSL

SEQ ID NO: 448 - protein, 12 aa, Artificial Sequence
  Synthetic Construct
KAIQLTYNQVSL

SEQ ID NO: 449 - protein, 12 aa, Artificial Sequence
  Synthetic Construct
AEPWTNRNTDGS

SEQ ID NO: 450 - protein, 12 aa, Artificial Sequence
  Synthetic Construct
AEPWTVRNTDGS

SEQ ID NO: 451 - protein, 8 aa, Artificial Sequence
  Synthetic Construct
KQLRVVNG

SEQ ID NO: 452 - protein, 13 aa, Artificial Sequence
  Synthetic Construct
KQLRVVTGRGDSP

SEQ ID NO: 453 - protein, 13 aa, Artificial Sequence
  Synthetic Construct
KQLRVVNGRGDSP

SEQ ID NO: 454 - protein, 13 aa, Artificial Sequence
  Synthetic Construct
PSSRRRVVRKGVS

SEQ ID NO: 455 - protein, 13 aa, Artificial Sequence
  Synthetic Construct
PSSRRRVNRKGVS

SEQ ID NO: 456 - protein, 13 aa, Artificial Sequence
  Synthetic Construct
SPGRVVTGRGDSP

SEQ ID NO: 457 - protein, 13 aa, Artificial Sequence
  Synthetic Construct
SPGRVVGGRGDSP

SEQ ID NO: 458 - protein, 13 aa, Artificial Sequence
  Synthetic Construct
NSGRAVTGRGDSP

SEQ ID NO: 459 - protein, 13 aa, Artificial Sequence
  Synthetic Construct
NSGRAVTYRGDSP

SEQ ID NO: 460 - protein, 13 aa, Artificial Sequence
  Synthetic Construct
TGHGQPSSRRRVN

SEQ ID NO: 461 - protein, 13 aa, Artificial Sequence
  Synthetic Construct
TGHGQASSRRRVN

SEQ ID NO: 462 - protein, 13 aa, Artificial Sequence
  Synthetic Construct
TGHGQSSSRGPYH

SEQ ID NO: 463 - protein, 13 aa, Artificial Sequence
  Synthetic Construct
TGHGQASSRGPYH

SEQ ID NO: 464 - protein, 13 aa, Artificial Sequence
  Synthetic Construct
RGSVILTKNQVSL

SEQ ID NO: 465 - protein, 13 aa, Artificial Sequence
  Synthetic Construct
RGSVILTVNQVSL

SEQ ID NO: 466 - protein, 13 aa, Artificial Sequence
  Synthetic Construct
SPGRVVGINYWLA

SEQ ID NO: 467 - protein, 13 aa, Artificial Sequence
  Synthetic Construct
SPGRVVGGNYWLA

SEQ ID NO: 468 - protein, 13 aa, Artificial Sequence
  Synthetic Construct
SPGRVVGSNKGAI

SEQ ID NO: 469 - protein, 13 aa, Artificial Sequence
  Synthetic Construct
SPGRVVGGNKGAI

SEQ ID NO: 470 - protein, 13 aa, Artificial Sequence
  Synthetic Construct
PGARGRAPNHAVV

SEQ ID NO: 471 - protein, 13 aa, Artificial Sequence
  Synthetic Construct
PGARGRAFNHAVV

SEQ ID NO: 472 - protein, 13 aa, Artificial Sequence
  Synthetic Construct
PGARGNAFNNLDR

SEQ ID NO: 473 - protein, 13 aa, Artificial Sequence
  Synthetic Construct
PGARGRAFNNLDR

SEQ ID NO: 474 - protein, 13 aa, Artificial Sequence
  Synthetic Construct
VSNKYISNNEQLP

SEQ ID NO: 475 - protein, 13 aa, `Artificial Sequence
  Synthetic Construct
VSNKYFSNNEQLP

SEQ ID NO: 476 - protein, 12 aa, Artificial Sequence
  Synthetic Construct
KVSNKALHVTNI

SEQ ID NO: 477 - protein, 12 aa, Artificial Sequence
  Synthetic Construct
KVSNKALPVTNI

SEQ ID NO: 478 - protein, 13 aa, Artificial Sequence
  Synthetic Construct
VTGRGPSPDVPLT

SEQ ID NO: 479 - protein, 13 aa, Artificial Sequence
  Synthetic Construct
VTGRGDSPDVPLT

SEQ ID NO: 480 - protein, 13 aa, Artificial Sequence
  Artificial Sequence
TGHGQRSSNIRTS

SEQ ID NO: 481 - protein, 13 aa, Artificial Sequence
  Synthetic Construct
TGHGQASSNIRTS

SEQ ID NO: 482 - protein, 13 aa, Artificial Sequence
  Synthetic Construct
TGHGQHSSNIANI

SEQ ID NO: 483 - protein, 13 aa, Artificial Sequence
  Synthetic Construct
TGHGQASSNIANI

SEQ ID NO: 484 - protein, 13 aa, Artificial Sequence
  Synthetic Construct
TGHGQASRNDYSY

SEQ ID NO: 485 - protein, 13 aa, Artificial Sequence
  Synthetic Construct
TGHGQASSNDYSY

SEQ ID NO: 486 - protein, 13 aa, Artificial Sequence
  Synthetic Construct
KALHVTNRNTDGS

SEQ ID NO: 487 - protein, 13 aa, Artificial Sequence
  Synthetic Construct
KALHVTNINTDGS

SEQ ID NO: 488 - protein, 13 aa, Artificial Sequence
  Synthetic Construct
RVVRKKVSNKALP

SEQ ID NO: 489 - protein, 13 aa, Artificial Sequence
  Synthetic Construct
RVVRKGVSNKALP

SEQ ID NO: 490 - protein, 13 aa, Artificial Sequence
  Synthetic Construct
RQARVVGINYWLA

SEQ ID NO: 491 - protein, 13 aa, Artificial Sequence
  Synthetic Construct
RQARVVGGNYWLA

SEQ ID NO: 492 - protein, 21 aa, Artificial Sequence
  Synthetic Construct
GKQLRVVNGYSSEDNMLLGGP

SEQ ID NO: 493 - protein, 21 aa, Artificial Sequence
  Synthetic Construct
GKQLRVVGGLVHLKNTMETGP

SEQ ID NO: 494 - protein, 12 aa, Artificial Sequence
  Synthetic Construct
AGQPKQLRVVNG

SEQ ID NO: 495 - protein, 12 aa, Artificial Sequence
  Synthetic Construct
AGQPLQLRVVNG

SEQ ID NO: 496 - protein, 12 aa, Artificial Sequence
  Synthetic Construct
AGQPLQERVVNG

SEQ ID NO: 497 - protein, 12 aa, Artificial Sequence
  Synthetic Construct
AGQPKQERVVNG

SEQ ID NO: 498 - protein, 12 aa, Artificial Sequence
  Synthetic Construct
GTANKQLRVVNG

SEQ ID NO: 499 - protein, 12 aa, Artificial Sequence
  Synthetic Construct
GTANKQLHVVNG

SEQ ID NO: 500 - protein, 12 aa, Artificial Sequence
  Synthetic Construct
GTANIQLRVVNG

SEQ ID NO: 501 - protein, 12 aa, Artificial Sequence
  Synthetic Construct
GTANIQLHVVNG

SEQ ID NO: 502 - protein, 21 aa, Artificial Sequence
  Synthetic Construct
GKQLRVVNEYSSMDNMLLGGP

SEQ ID NO: 503 - protein, 21 aa, Artificial Sequence
  Synthetic Construct
GKQLRVVNEYSSEDNMLLGGP

SEQ ID NO: 504 - protein, 12 aa, Artificial Sequence
  Synthetic Construct
KQLRTVAGLAGK

SEQ ID NO: 505 - protein, 12 aa, Artificial Sequence
  Synthetic Construct
KQLRTVNGLAGK

SEQ ID NO: 506 - protein, 12 aa, Artificial Sequence
  Synthetic Construct
KQLRVVAGLAGK

SEQ ID NO: 507 - protein, 12 aa, Artificial Sequence
  Synthetic Construct
KQLRVVNGLAGK

SEQ ID NO: 508 - protein, 12 aa, Artificial Sequence
  Synthetic Construct
GIKYKQLRVVNG

SEQ ID NO: 509 - protein, 12 aa, Artificial Sequence
  Synthetic Construct
GIKYKYLRVVNG

SEQ ID NO: 510 - protein, 12 aa, Artificial Sequence
  Synthetic Construct
GIKYLQLRVVNG

SEQ ID NO: 511 - protein, 12 aa, Artificial Sequence
  Synthetic Construct
GIKYLYLRVVNG

SEQ ID NO: 512 - protein, 16 aa, Artificial Sequence
  Synthetic Construct
THLDLTYSRSKYLATA

SEQ ID NO: 513 - protein, 16 aa, Artificial Sequence
  Synthetic Construct
THLDLTPSRSKYLATA

SEQ ID NO: 514 - protein, 16 aa, Artificial Sequence
  Synthetic Construct
THLDLTYSRSRYLATA

SEQ ID NO: 515 - protein, 16 aa, Artificial Sequence
  Synthetic Construct
THLDLTPSRSRYLATA

SEQ ID NO: 516 - protein, 16 aa, Artificial Sequence
  Synthetic Construct
TYSRSKYLAPANGNAE

SEQ ID NO: 517 - protein, 16 aa, Artificial Sequence
  Synthetic Construct
TYSRSKYLATANGNAE

SEQ ID NO: 518 - protein, 16 aa, Artificial Sequence
  Synthetic Construct
TYSRSRYLAPANGNAE

SEQ ID NO: 519 - protein, 16 aa, Artificial Sequence
  Synthetic Construct
TYSRSRYLATANGNAE

SEQ ID NO: 520 - protein, 17 aa, Artificial Sequence
  Synthetic Construct
DPVNFKQLRVVNEYSSE

SEQ ID NO: 521 - protein, 17 aa, Artificial Sequence
  Synthetic Construct
DPVNFKQLRVVNGYSSE

SEQ ID NO: 522 - protein, 17 aa, Artificial Sequence
  Synthetic Construct
DPVNFKKLRVVNEYSSE

SEQ ID NO: 523 - protein, 17 aa, Artificial Sequence
  Synthetic Construct
DPVNFKKLRVVNGYSSE

SEQ ID NO: 524 - protein, 16 aa, Artificial Sequence
  Synthetic Construct
RKGKAGAAKNLNEKDY

SEQ ID NO: 525 - protein, 16 aa, Artificial Sequence
  Synthetic Construct
RKGKAGAAKNLYEKDY

SEQ ID NO: 526 - protein, 16 aa, Artificial Sequence
  Synthetic Construct
RKGKAGAAQNLNEKDY

SEQ ID NO: 527 - protein, 16 aa, Artificial Sequence
  Synthetic Construct
RKGKAGAAQNLYEKDY

SEQ ID NO: 528 - protein, 17 aa, Artificial Sequence
  Synthetic Construct
VTGRGDSHSLTKNQVSL

SEQ ID NO: 529 - protein, 17 aa, Artificial Sequence
  Synthetic Construct
VTGRGDSHSLTTNQVSL

SEQ ID NO: 530 - protein, 17 aa, Artificial Sequence
  Synthetic Construct
VTGRGDSPSLTKNQVSL

SEQ ID NO: 531 - protein, 17 aa, Artificial Sequence
  Synthetic Construct
VTGRGDSPSLTTNQVSL

SEQ ID NO: 532 - protein, 17 aa, Artificial Sequence
  Synthetic Construct
TGHGQASSERSSNIRTS

SEQ ID NO: 533 - protein, 17 aa, Artificial Sequence
  Synthetic Construct
TGHGQASSERSSNSRTS

SEQ ID NO: 534 - protein, 17 aa, Artificial Sequence
  Synthetic Construct
TGHGQASSERSSTIRTS

SEQ ID NO: 535 - protein, 17 aa, Artificial Sequence
  Synthetic Construct
TGHGQASSERSSTSRTS

SEQ ID NO: 536 - protein, 17 aa, Artificial Sequence
  Synthetic Construct
GISSGLLSGRSDQPSGP

SEQ ID NO: 537 - protein, 20 aa, Artificial Sequence
  Synthetic Construct
GGSGISSGLLSGRSDQPSGP

SEQ ID NO: 538 - protein, 17 aa, Artificial Sequence
  Synthetic Construct
DPVNFKLLRVVNEYSSE

SEQ ID NO: 539 - protein, 17 aa, Artificial Sequence
  Synthetic Construct
DPVNFKLLRVVNGYSSE

SEQ ID NO: 540 - protein, 17 aa, Artificial Sequence
  Synthetic Construct
DPVNFKQLRVVGGLVAL

SEQ ID NO: 541 - protein, 17 aa, Artificial Sequence
  Synthetic Construct
DPVNFKQLRVVNGLVAL

SEQ ID NO: 542 - protein, 17 aa, Artificial Sequence
  Synthetic Construct
DPVNFKLLRVVGGLVAL

SEQ ID NO: 543 - protein, 17 aa, Artificial Sequence
  Synthetic Construct
DPVNFKLLRVVNGLVAL

SEQ ID NO: 544 - protein, 12 aa, Artificial Sequence
  Synthetic Construct
KQLRVQNGDSTE

SEQ ID NO: 545 - protein, 12 aa, Artificial Sequence
  Synthetic Construct
KQLRVVNNDATE

SEQ ID NO: 546 - protein, 12 aa, Artificial Sequence
  Synthetic Construct
KQLRVVNGDSTE

SEQ ID NO: 547 - protein, 12 aa, Artificial Sequence
  Synthetic Construct
ISNNKQLRVVNG

SEQ ID NO: 548 - protein, 12 aa, Artificial Sequence
  Synthetic Construct
ISNNKQLPVVNG

SEQ ID NO: 549 - protein, 12 aa, Artificial Sequence
  Synthetic Construct
ISNNEQLRVVNG

SEQ ID NO: 550 - protein, 12 aa, Artificial Sequence
  Synthetic Construct
ISNNEQLPVVNG

SEQ ID NO: 551 - protein, 12 aa, Artificial Sequence
  Synthetic Construct
KVSNKQLRVVNG

SEQ ID NO: 552 - protein, 12 aa, Artificial Sequence
  Synthetic Construct
KVSNKQLPVVNG

SEQ ID NO: 553 - protein, 12 aa, Artificial Sequence
  Synthetic Construct
KVSNKALRVVNG

SEQ ID NO: 554 - protein, 12 aa, Artificial Sequence
  Synthetic Construct
KVSNKALPVVNG

SEQ ID NO: 555 - protein, 12 aa, Artificial Sequence
  Synthetic Construct
KQLRVQNNDATE

SEQ ID NO: 556 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 557 - protein, 560 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGGGGGGGGGGGGGGGGGGGGGGGGGGGGGGGGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 558 - protein, 538 aa, Artificial Sequence
  Synthetic Sequence
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGGGGSGGGGSGGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 559 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 560 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTKKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 561 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFAFAMPKKATELKHLQCLEEELKPLEEVLNGAQSKNFHLRPRDLISNINVIVLELKGSETTFMCEYADETATIVEFLNRWITFAQSIISTLT

SEQ ID NO: 562 - protein, 356 aa, Artificial Sequence
  Synthetic Construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTPSGPSAGGAAEIVLTQSPDFQSVTPKEKVTITCSANSALSYMYWYQQKPDQSPKLWVHGTSNLASGVPSRFSGSGSGTDFTLTINSLEAEDAATYYCHHWSNTQWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 563 - protein, 622 aa, Artificial Sequence
  Synthetic Construct
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGPPASAGSQVQLVQSGAEVKKPGSSVKVSCKASGYTFTNYFMNWVRQAPGQGLEWMGRVDPEQGRADYAEKFKKRVTITADKSTSTAYMELSSLRSEDTAVYYCARRAMDNYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 564 - protein, 622 aa, Artificial Sequence
  Synthetic Construct
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGSPPAGGAPQVQLVQSGAEVKKPGSSVKVSCKASGYTFTNYFMNWVRQAPGQGLEWMGRVDPEQGRADYAEKFKKRVTITADKSTSTAYMELSSLRSEDTAVYYCARRAMDNYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 565 - protein, 356 aa, Artificial Sequence
  Synthetic Construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGPGSGSGGAAEIVLTQSPDFQSVTPKEKVTITCSANSALSYMYWYQQKPDQSPKLWVHGTSNLASGVPSRFSGSGSGTDFTLTINSLEAEDAATYYCHHWSNTQWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 566 - protein, 567 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 567 - protein, 768 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGGGGGGGGGGGGGGGGGGGGGGGGGGGGGGGGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 568 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLT

SEQ ID NO: 569 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTKKFYMPKKATELKHLQCLEEELKPLEEVLNLAQSKNFHFDPRDVVSNINVFVLELKGSETTFMCEYADETATIVEFLNRWITFAQSIISTLT

SEQ ID NO: 570 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTAKFAMPKKATELKHLQCLEEELKPLEEVLNGAQSKNFHFDPRDVVSNINVFVLELKGSETTFMCEYADETATIVEFLNRWITFAQSIISTLT

SEQ ID NO: 571 - protein, 550 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGSGGGGSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 572 - protein, 555 aa, Artificial Sequence
  Artificial Sequence
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGSGGGGSGGGGSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 573 - protein, 560 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGSGGGGSGGGGSGGGGSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 574 - protein, 565 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGSGGGGSGGGGSGGGGSGGGGSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 575 - protein, 560 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGGGGGGGGGGGGGGGGGGGGGGGGGGGGGGGGAPTSSSTKKTQLQLEHLLLDLQMILNGINNYKNPKLTRMLTFKFYMPKKATELKHLQCLEEELKPLEEVLNLAQSKNFHFDPRDVVSNINVFVLELKGSETTFMCEYADETATIVEFLNRWITFAQSIISTLT

SEQ ID NO: 576 - protein, 550 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGSGGGGSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHFDPRDVVSNINVFVLELKGSETTFMCEYADETATIVEFLNRWITFAQSIISTLT

SEQ ID NO: 577 - protein, 555 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGSGGGGSGGGGSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHFDPRDVVSNINVFVLELKGSETTFMCEYADETATIVEFLNRWITFAQSIISTLT

SEQ ID NO: 578 - protein, 560 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGSGGGGSGGGGSGGGGSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHFDPRDVVSNINVFVLELKGSETTFMCEYADETATIVEFLNRWITFAQSIISTLT

SEQ ID NO: 579 - protein, 565 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGSGGGGSGGGGSGGGGSGGGGSGGGGSGGGGSGGGGSAPTSSSTKKTQLQLEHLLLDLQMILNGINNYKNPKLTRMLTFKFYMPKKATELKHLQCLEEELKPLEEVLNLAQSKNFHFDPRDVVSNINVFVLELKGSETTFMCEYADETATIVEFLNRWITFAQSIISTLT

SEQ ID NO: 580 - protein, 533 aa, Artificial Sequence
  Synthetic Construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGGGGSGGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 581 - protein, 543 aa, Artificial Sequence
  Synthetic Construct
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGGGGSGGGGSGGGGSGGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 582 - protein, 538 aa, Artificial Sequence
  Synthetic Construct
APTSSSTKKTQLQLEHLLLDLQMILNGINNYKNPKLTRMLTFKFYMPKKATELKHLQCLEEELKPLEEVLNLAQSKNFHFDPRDVVSNINVFVLELKGSETTFMCEYADETATIVEFLNRWITFAQSIISTLTGGGGSGGGGSGGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 583 - protein, 533 aa, Artificial Sequence
  Synthetic Construct
APTSSSTKKTQLQLEHLLLDLQMILNGINNYKNPKLTRMLTFKFYMPKKATELKHLQCLEEELKPLEEVLNLAQSKNFHFDPRDVVSNINVFVLELKGSETTFMCEYADETATIVEFLNRWITFAQSIISTLTGGGGSGGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 584 - protein, 543 aa, Artificial Sequence
  Synthetic Construct
APTSSSTKKTQLQLEHLLLDLQMILNGINNYKNPKLTRMLTFKFYMPKKATELKHLQCLEEELKPLEEVLNLAQSKNFHFDPRDVVSNINVFVLELKGSETTFMCEYADETATIVEFLNRWITFAQSIISTLTGGGGSGGGGSGGGGSGGGGSELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 585 - protein, 568 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGSSGGPPGGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 586 - protein, 569 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTSGSPSGSGGGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 587 - protein, 569 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGPPGPPGSSGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 588 - protein, 570 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGSSSGPPGPPSMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 589 - protein, 568 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLTGSSGGPPGGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 590 - protein, 569 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLTSGSPSGSGGGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 591 - protein, 569 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLTGPPGPPGSSGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 592 - protein, 570 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLTGSSSGPPGPPSMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 593 - protein, 567 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLTGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 594 - protein, 568 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLTGSSGGPPGGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 595 - protein, 569 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLTSGSPSGSGGGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 596 - protein, 569 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLTGPPGPPGSSGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 597 - protein, 570 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLTGSSSGPPGPPSMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 598 - protein, 769 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGGGGGGGGGGGGGGGGGGGGGGGGGGGGGGGGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGSSGGPPGGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 599 - protein, 770 aa, Synthetic Construct
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGGGGGGGGGGGGGGGGGGGGGGGGGGGGGGGGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTSGSPSGSGGGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 600 - protein, 770 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGGGGGGGGGGGGGGGGGGGGGGGGGGGGGGGGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGPPGPPGSSGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 601 - protein, 771 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGGGGGGGGGGGGGGGGGGGGGGGGGGGGGGGGGGGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGSSSGPPGPPSMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 602 - protein, 592 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 603 - protein, 418 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 604 - protein, 370 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPMPYDLYHPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 605 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPPMPYDLYHPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 606 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPSMPYDLYHPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 607 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHFDPRDVVSNINVFVLELKGSETTFMCEYADETATIVEFLNRWITFAQSIISTLT

SEQ ID NO: 608 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 609 - protein, 419 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 610 - protein, 477 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDF

SEQ ID NO: 611 - protein, 478 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGSSGGPPGGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDF

SEQ ID NO: 612 - protein, 479 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTSGSPSGSGGGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDF

SEQ ID NO: 613 - protein, 479 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGPPGPPGSSGMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDF

SEQ ID NO: 614 - protein, 480 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTGSSSGPPGPPSMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDF

SEQ ID NO: 615 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 616 - protein, 227 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 617 - protein, 434 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 618 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLTCLVEGFYPSDIAVEWESNGQPENNYKTTPPVLDSDGSFFLYSKLTVDKSRWQQGNVFSCSVMHEALHNHYTQESLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 619 - protein, 227 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 620 - protein, 434 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLTCLVKGFYPSDIAVEWESNGQPENNYKTTPPVLDSDGSFFLYSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 621 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYDTTPPVLDSDGSFFLVSDLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 622 - protein, 227 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKELTKNQVSLWCLVKGFYPSDIAVEWESNGQPENNYKTTPPVLKSDGSFFLYSKLTVDKSRWQQGNVFSCSVMHEALHNHYTQKSLSLSPGK

SEQ ID NO: 623 - protein, 434 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKELTKNQVSLWCLVKGFYPSDIAVEWESNGQPENNYKTTPPVLKSDGSFFLYSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 624 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVEGFYPSDIAVEWESNGQPENNYKTTPPVLDSDGSFFLVSKLTVDKSRWQQGNVFSCSVMHEALHNHYTQESLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 625 - protein, 227 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 626 - protein, 434 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLWCLVKGFYPSDIAVEWESNGQPENNYKTTPPVLDSDGSFFLYSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQ

SEQ ID NO: 627 - protein, 387 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTPGPGPMPYDLYHPSGGCGGHQYERRGGC

SEQ ID NO: 628 - protein, 387 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTPGPGPMPYDLYHPSGGCSGHQYERREGC

SEQ ID NO: 629 - protein, 387 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTPGPGPMPYDLYHPSGGCGGHYFERHGGC

SEQ ID NO: 630 - protein, 387 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTPGPGPMPYDLYHPSGGCSGHYFERHEGC

SEQ ID NO: 631 - protein, 387 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTPGPGPMPYDLYHPSGGCSFHQYERHEGC

SEQ ID NO: 632 - protein, 387 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTPSGSSMPYDLYHPSGGCGGHQYERRGGC

SEQ ID NO: 633 - protein, 387 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTPSGSSMPYDLYHPSGGCSGHQYERREGC

SEQ ID NO: 634 - protein, 387 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTPSGSSMPYDLYHPSGGCGGHYFERHGGC

SEQ ID NO: 635 - protein, 387 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTPSGSSMPYDLYHPSGGCSGHYFERHEGC

SEQ ID NO: 636 - protein, 387 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLTPSGSSMPYDLYHPSGGCSFHQYERHEGC

SEQ ID NO: 637 - protein, 444 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 638 - protein, 459 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 639 - protein, 459 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLTCLVKGFYPSDIAVEWESNGQPENNYKTTPPVLDSDGSFFLYSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 640 - protein, 459 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKELTKNQVSLWCLVKGFYPSDIAVEWESNGQPENNYKTTPPVLKSDGSFFLYSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 641 - protein, 459 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLWCLVKGFYPSDIAVEWESNGQPENNYKTTPPVLDSDGSFFLYSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 642 - protein, 592 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLTGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 643 - protein, 592 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLTGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 644 - protein, 419 aa, Artificial Sequence; identical to SEQ ID NO: 609
  Synthetic Construct

SEQ ID NO: 645 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILCLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 646 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILLLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 647 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILCLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 648 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILLLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 649 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLCLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 650 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 651 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILLLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 652 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILLLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 653 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 654 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLCLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 655 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 656 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEHLLLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 657 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILCLLLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 658 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILLLLLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 659 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILLLLLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 660 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILCLFLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 661 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILLLFLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 662 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAPTSSSTKKTQLQLEILLLFLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 663 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYDTTPPVLDSDGSFFLVSDLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 664 - protein, 443 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKELTKNQVSLWCLVKGFYPSDIAVEWESNGQPENNYKTTPPVLKSDGSFFLYSKLTVDKSRWQQGNVFSCSVMHEALHNHYTQKSLSLSPGPGSGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 665 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVEGFYPSDIAVEWESNGQPENNYKTTPPVLDSDGSFFLVSKLTVDKSRWQQGNVFSCSVMHEALHNHYTQESLSLSPGGGSSPPMPYDLYHPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 666 - protein, 443 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLWCLVKGFYPSDIAVEWESNGQPENNYKTTPPVLDSDGSFFLYSKLTVDKSRWQQGNVFSCSVMHEALHNHYTQKSLSLSPGPGSGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 667 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 668 - protein, 21 aa, Artificial Sequence
  Synthetic Construct
GGSSPPMPYDLYHPSGPGSGS

SEQ ID NO: 669 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTAMLTAKFAMPKKATELKHLQCLEEALKPLEEVLNLAQSKNFHFDPRDVVSNINVFVLELKGSETTFMCEYADETATIVEFLNRWITFAQSIISTLT

SEQ ID NO: 670 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 671 - protein, 443 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGPGSGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 672 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGISSGLLSGRSDNHSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 673 - protein, 382 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGAVGLLAPPGGLSGRSDNHSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 674 - protein, 372 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 675 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPVPLSLYSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 676 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSPGGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 677 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPRAAAVKSPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 678 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGPGGPRAAAVKSPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 679 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGRAAAVKSPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 680 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPRAAAVKSPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 681 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGPGGPRAAAVKSPSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 682 - protein, 372 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGHEQLTVSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 683 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPHEQLTVSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 684 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPPGGHEQLTVSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 685 - protein, 372 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGHEQLTVSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 686 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPHEQLTVSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 687 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPPGGHEQLTVSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 688 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGPDSGGFMLTSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 689 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGPGSPGDSGGFMLTSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 690 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSSPPGDSGGFMLTSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 691 - protein, 17 aa, Artificial Sequence
  Synthetic Construct
GISSGLLSGRSDNHGGP

SEQ ID NO: 692 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGPGSPGDSGGFMLTSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 693 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSSPPGDSGGFMLTSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 694 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGISSGLLSGRSDNHSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 695 - protein, 382 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGAVGLLAPPGGLSGRSDNHSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 696 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSPGGVPLSLYSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 697 - protein, 372 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 698 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGRAAAVKSPSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 699 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 700 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 701 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFYMPKKATELKHLQCLEERLKPLEEVLNLAQSKNFHLRPRDLISNINVIVLELKGSETTFMCEYADETATIVEFLNRWITFAQSIISTLT

SEQ ID NO: 702 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTEKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 703 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFNMPKKATELKHLQCLEEELKPLEEVLNLAQSKNFHLRPRDLISNINVIVLELKGSETTFMCEYADETATIVEFLNRWITFAQSIISTLT

SEQ ID NO: 704 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 705 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 706 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFRMPKKATELKHLQCLEEELKPLEEVLNLAQSKNFHLRPRDLISNINVIVLELKGSETTFMCEYADETATIVEFLNRWITFAQSIISTLT

SEQ ID NO: 707 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFAFYMPKKATELKHLQCLEEELKPLEEVLNLAQSKNFHLRPRDLISNINVIVLELKGSETTFMCEYADETATIVEFLNRWITFAQSIISTLT

SEQ ID NO: 708 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTFKFAMPKKATELKHLQCLEESLKPLEEVLNLAQSKNFHLRPRDLISNINVIVLELKGSETTFMCEYADETATIVEFLNRWITFAQSIISTLT

SEQ ID NO: 709 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 710 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPAPTSSSTKKTQLQLEHLLLDLQMILNGINNYKNPKLTGMLTFKFAMPKKATELKHLQCLEESLKPLEEVLNLAQSKNFHLRPRDLISNINVIVLELKGSETTFMCEYADETATIVEFLNRWITFAQSIISTLT

SEQ ID NO: 711 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPVPLSLYSGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 712 - protein, 443 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 713 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGISSGLLSGRSDNHGGPAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 714 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGISSGLLSGRSDNHGGPAPTSSSTKKTQLQLEHLLLDLQMILNGINNYKNPKLTAMLTAKFAMPKKATELKHLQCLEEALKPLEEVLNLAQSKNFHLRPRDLISNINVIVLELKGSETTFMCEYADETATIVEFLNRWITFAQSIISTLT

SEQ ID NO: 715 - protein, 361 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPGSGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 716 - protein, 459 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGPPSGSSPMPYDLYHPSGGGAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKD

SEQ ID NO: 717 - protein, 372 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTFKFYMPKKATELKHLQCLEERLKPLEEVLNLAQSKNFHLRPRDLISNINVIVLELKGSETTFMCEYADETATIVEFLNRWITFAQSIISTLT

SEQ ID NO: 718 - protein, 372 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTEKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 719 - protein, 372 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTFKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 720 - protein, 372 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 721 - protein, 226 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLTCLVEGFYPSDIAVEWESNGQPENNYKTTPPVLDSDGSFFLYSKLTVDKSRWQQGNVFSCSVMHEALHNHYTQESLSLSPG

SEQ ID NO: 722 - protein, 372 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTFKFRMPKKATELKHLQCLEEELKPLEEVLNLAQSKNFHLRPRDLISNINVIVLELKGSETTFMCEYADETATIVEFLNRWITFAQSIISTLT

SEQ ID NO: 723 - protein, 372 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSPGVPLSLYSGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 724 - protein, 17 aa, Artificial Sequence
  Synthetic Construct
GISSGLLSGRSDNPSGP

SEQ ID NO: 725 - protein, 20 aa, Artificial Sequence
  Synthetic Construct
GGSGISSGLLSGRSDNPSGP

SEQ ID NO: 726 - protein, 372 aa, Artificial Sequence; identical to SEQ ID NO: 697
  Synthetic Construct

SEQ ID NO: 727 - protein, 3 aa, Artificial Sequence
  Synthetic Construct
SGS

SEQ ID NO: 728 - protein, 374 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGRAAAVKSPSGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 729 - protein, 373 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGISSGLLSGRSSGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 730 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGISSGLLSGRSSGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 731 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGISSGLLSGRSDNPSGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 732 - protein, 379 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGISSGLLSGRSDNPSGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 733 - protein, 376 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGISSGLLSGRSDQPSGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 734 - protein, 379 aa, Artificial Sequence
  Synthetic Constuct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSGISSGLLSGRSDQPSGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 735 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGKQLRVVNEYSSMDNMLLGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 736 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGKQLRVVNEYSSEDNMLLGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 737 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGKQLRVVNGYSSEDNMLLGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 738 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGKQLRVVGGLVHLKNTMETGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 739 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGTRDRLDEVNFKQLRVVNGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 740 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGTRDRLDEVNFKLLRVVNGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 741 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGTRDRLDPVNFKQLRVVNGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 742 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGTRDRLDPVNFKLLRVVNGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 743 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGNPMGSEPVNFKQLRVVNGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 744 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGNPMGSEPVNFKLLRVVNGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 745 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGNPMGSDPVNFKQLRVVNGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 746 - protein, 380 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGNPMGSDPVNFKLLRVVNGGPAPTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 747 - protein, 362 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPSGSPGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 748 - protein, 362 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPSGSPGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 749 - protein, 557 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPSGSPGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 750 - protein, 484 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPSGSPGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAAS

SEQ ID NO: 751 - protein, 361 aa, Artificial Sequence
  Synthetic Constuct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPGGGSSGGGSGPGSGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 752 - protein, 556 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPGSGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 753 - protein, 483 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPMPYDLYHPSGPGSGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAAS

SEQ ID NO: 754 - protein, 359 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPVPLSLYSGPGSGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 755 - protein, 672 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDPGGPSPVPLSLYSGGPITCPPPMSVEHADIWVKSYSLYSRERYICNSGFKRKAGTSSLTECVLNKATNVAHWTTPSLKCIRDPALVHQRPAPPSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 756 - protein, 673 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDSGSGGSPVPLSLYSGGPITCPPPMSVEHADIWVKSYSLYSRERYICNSGFKRKAGTSSLTECVLNKATNVAHWTTPSLKCIRDPALVHQRPAPPSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 757 - protein, 672 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDGGGSSPVPLSLYSGGPITCPPPMSVEHADIWVKSYSLYSRERYICNSGFKRKAGTSSLTECVLNKATNVAHWTTPSLKCIRDPALVHQRPAPPSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 758 - protein, 555 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPVPLSLYSGPSGSPGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGSGGGSGGGSGGGSGGGSGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 759 - protein, 559 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPVPLSLYSGPSGSPGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGSGGGSGGGSGGGSGGGSGGGSGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 760 - protein, 486 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPVPLSLYSGPGSGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSGGGGSITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAAS

SEQ ID NO: 761 - protein, 559 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGSSPPVPLSLYSGPGSGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSGGGGSITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 762 - protein, 28 aa, Artificial Sequence
  Synthetic Construct
PGPGPMPYDLYHPSGGCGGHQYERRGGC

SEQ ID NO: 763 - protein, 28 aa, Artificial Sequence
  Synthetic Construct
PGPGPMPYDLYHPSGGCSGHQYERREGC

SEQ ID NO: 764 - protein, 28 aa, Artificial Sequence
  Synthetic Construct
PGPGPMPYDLYHPSGGCGGHYFERHGGC

SEQ ID NO: 765 - protein, 28 aa, Artificial Sequence
  Synthetic Construct
PGPGPMPYDLYHPSGGCSGHYFERHEGC

SEQ ID NO: 766 - protein, 28 aa, Artificial Sequence
  Synthetic Construct
PGPGPMPYDLYHPSGGCSFHQYERHEGC

SEQ ID NO: 767 - protein, 28 aa, Artificial Sequence
  Synthetic Construct
PSGSSMPYDLYHPSGGCGGHQYERRGGC

SEQ ID NO: 768 - protein, 28 aa, Artificial Sequence
  Synthetic Construct
PSGSSMPYDLYHPSGGCSGHQYERREGC

SEQ ID NO: 769 - protein, 28 aa, Artificial Sequence
  Synthetic Construct
PSGSSMPYDLYHPSGGCGGHYFERHGGC

SEQ ID NO: 770 - protein, 28 aa, Artificial Sequence
  Synthetic Construct
PSGSSMPYDLYHPSGGCSGHYFERHEGC

SEQ ID NO: 771 - protein, 28 aa, Artificial Sequence
  Synthetic Construct
PSGSSMPYDLYHPSGGCSFHQYERHEGC

SEQ ID NO: 772 - protein, 226 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 773 - protein, 226 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKELTKNQVSLWCLVKGFYPSDIAVEWESNGQPENNYKTTPPVLKSDGSFFLYSKLTVDKSRWQQGNVFSCSVMHEALHNHYTQKSLSLSPG

SEQ ID NO: 774 - protein, 226 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCRKKLTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 775 - protein, 133 aa, Artificial Sequence
  Synthetic Construct
APTSSSTKKTQLQLEILCLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 776 - protein, 133 aa, Artificial Sequence
  Synthetic Construct
APTSSSTKKTQLQLEILLLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 777 - protein, 133 aa, Artificial Sequence
  Synthetic Construct
APTSSSTKKTQLQLEILCLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 778 - protein, 133 aa, Artificial Sequence
  Synthetic Construct
APTSSSTKKTQLQLEILLLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 779 - protein, 133 aa, Artificial Sequence
  Synthetic Construct
APTSSSTKKTQLQLEHLCLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 780 - protein, 133 aa, Artificial Sequence
  Synthetic Construct
APTSSSTKKTQLQLEHLLLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 781 - protein, 133 aa, Artificial Sequence
  Synthetic Construct
APTSSSTKKTQLQLEILLLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 782 - protein, 133 aa, Artificial Sequence
  Synthetic Construct
APTSSSTKKTQLQLEILLLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 783 - protein, 133 aa, Artificial Sequence
  Synthetic Construct
APTSSSTKKTQLQLEHLLLLLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 784 - protein, 133 aa, Artificial Sequence
  Synthetic Construct
APTSSSTKKTQLQLEHLCLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 785 - protein, 133 aa, Artificial Sequence
  Synthetic Construct
APTSSSTKKTQLQLEHLLLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 786 - protein, 133 aa, Artificial Sequence
  Synthetic Construct
APTSSSTKKTQLQLEHLLLFLQMILNGILNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 787 - protein, 133 aa, Artificial Sequence
  Synthetic Construct
APTSSSTKKTQLQLEILCLLLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 788 - protein, 133 aa, Artificial Sequence
  Synthetic Construct
APTSSSTKKTQLQLEILLLLLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 789 - protein, 133 aa, Artificial Sequence
  Synthetic Construct
APTSSSTKKTQLQLEILLLLLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 790 - protein, 133 aa, Artificial Sequence
  Synthetic Construct
APTSSSTKKTQLQLEILCLFLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 791 - protein, 133 aa, Artificial Sequence
  Synthetic Construct
APTSSSTKKTQLQLEILLLFLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFIQSIISTLT

SEQ ID NO: 792 - protein, 133 aa, Artificial Sequence
  Synthetic Construct
APTSSSTKKTQLQLEILLLFLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 793 - protein, 226 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYDTTPPVLDSDGSFFLVSDLTVDKSRWQQGNVFSCSVMHEALHNHYTQKSLSLSPG

SEQ ID NO: 794 - protein, 2 aa, Artificial Sequence
  Synthetic Construct
SG

SEQ ID NO: 795 - protein, 4 aa, Artificial Sequence
  Synthetic Construct
PGSG

SEQ ID NO: 796 - protein, 226 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVEGFYPSDIAVEWESNGQPENNYKTTPPVLDSDGSFFLVSKLTVDKSRWQQGNVFSCSVMHEALHNHYTQESLSLSPG

SEQ ID NO: 797 - protein, 14 aa, Artificial Sequence
  Synthetic Construct
GISSGLLSGRSSGP

SEQ ID NO: 798 - protein, 17 aa, Artificial Sequence
  Synthetic Construct
GGSGISSGLLSGRSSGP

SEQ ID NO: 799 - protein, 3 aa, Artificial Sequence
  Synthetic Construct
GSG

SEQ ID NO: 800 - protein, 17 aa, Artificial Sequence
  Synthetic Construct
GISSGLLSGRSDNHSGP

SEQ ID NO: 801 - protein, 23 aa, Artificial Sequence
  Synthetic Construct
GGAVGLLAPPGGLSGRSDNHSGP

SEQ ID NO: 802 - protein, 13 aa, Artificial Sequence
  Synthetic Construct
GSPGVPLSLYSGP

SEQ ID NO: 803 - protein, 15 aa, Artificial Sequence
  Synthetic Construct
GGSSPPVPLSLYSGP

SEQ ID NO: 804 - protein, 15 aa, Artificial Sequence
  Synthetic Construct
GGSPGGVPLSLYSGP

SEQ ID NO: 805 - protein, 17 aa, Artificial Sequence
  Synthetic Construct
GGSSPPRAAAVKSPSGP

SEQ ID NO: 806 - protein, 17 aa, Artificial Sequence
  Synthetic Construct
GGPGGPRAAAVKSPSGP

SEQ ID NO: 807 - protein, 15 aa, Artificial Sequence
  Synthetic Construct
GGSGRAAAVKSPSGP

SEQ ID NO: 808 - protein, 13 aa, Artificial Sequence
  Synthetic Construct
GGSGHEQLTVSGP

SEQ ID NO: 809 - protein, 15 aa, Artificial Sequence
  Synthetic Construct
GGSSPPHEQLTVSGP

SEQ ID NO: 810 - protein, 15 aa, Artificial Sequence
  Synthetic Construct
GSPPGGHEQLTVSGP

SEQ ID NO: 811 - protein, 15 aa, Artificial Sequence
  Synthetic Construct
GSGPDSGGFMLTSGP

SEQ ID NO: 812 - protein, 17 aa, Artificial Sequence
  Synthetic Construct
GPGSPGDSGGFMLTSGP

SEQ ID NO: 813 - protein, 133 aa, Artificial Sequence
  Synthetic Construct
APTSSSTKKTQLQLEHLLLDLQMILNGINNYKNPKLTRMLTSKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 814 - protein, 133 aa, Artificial Sequence
  Synthetic Construct
APTSSSTKKTQLQLEHLLLDLQMILNGINNYKNPKLTGMLTFKFAMPKKATELKHLQCLEESLKPLEEVLNLAQSKNFHLRPRDLISNINVIVLELKGSETTFMCEYADETATIVEFLNRWITFAQSIISTLT

SEQ ID NO: 815 - protein, 133 aa, Artificial Sequence
  Synthetic Construct
APTSSSTKKTQLQLEHLLLDLQMILNGINNYKNPKLTRMLTFKFYMPKKATELKHLQCLEERLKPLEEVLNLAQSKNFHLRPRDLISNINVIVLELKGSETTFMCEYADETATIVEFLNRWITFAQSIISTLT

SEQ ID NO: 816 - protein, 133 aa, Artificial Sequence
  Synthetic Construct
APTSSSTKKTQLQLEHLLLDLQMILNGINNYKNPKLTRMLTEKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 817 - protein, 133 aa, Artificial Sequence
  Synthetic Construct
APTSSSTKKTQLQLEHLLLDLQMILNGINNYKNPKLTRMLTFKFNMPKKATELKHLQCLEEELKPLEEVLNLAQSKNFHLRPRDLISNINVIVLELKGSETTFMCEYADETATIVEFLNRWITFAQSIISTLT

SEQ ID NO: 818 - protein, 133 aa, Artificial Sequence
  Synthetic Construct
APTSSSTKKTQLQLEHLLLDLQMILNGINNYKNPKLTRMLTFKFYMPKKATELKHLQCLEESLKPLEEVLNLAQSKNFHLRPRDLISNINVIVLELKGSETTFMCEYADETATIVEFLNRWITFAQSIISTLT

SEQ ID NO: 819 - protein, 133 aa, Artificial Sequence
  Synthetic Construct
APTSSSTKKTQLQLEHLLLDLQMILNGINNYKNPKLTRMLTAKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 820 - protein, 133 aa, Artificial Sequence
  Synthetic Construct
APTSSSTKKTQLQLEHLLLDLQMILNGINNYKNPKLTRMLTFKFRMPKKATELKHLQCLEEELKPLEEVLNLAQSKNFHLRPRDLISNINVIVLELKGSETTFMCEYADETATIVEFLNRWITFAQSIISTLT

SEQ ID NO: 821 - protein, 133 aa, Artificial Sequence
  Synthetic Construct
APTSSSTKKTQLQLEHLLLDLQMILNGINNYKNPKLTRMLTFAFYMPKKATELKHLQCLEEELKPLEEVLNLAQSKNFHLRPRDLISNINVIVLELKGSETTFMCEYADETATIVEFLNRWITFAQSIISTLT

SEQ ID NO: 822 - protein, 133 aa, Artificial Sequence
  Synthetic Construct
APTSSSTKKTQLQLEHLLLDLQMILNGINNYKNPKLTRMLTFKFAMPKKATELKHLQCLEESLKPLEEVLNLAQSKNFHLRPRDLISNINVIVLELKGSETTFMCEYADETATIVEFLNRWITFAQSIISTLT

SEQ ID NO: 823 - protein, 175 aa, Artificial Sequence
  Synthetic Construct
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 824 - protein, 102 aa, Artificial Sequence
  Synthetic Construct
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAAS

SEQ ID NO: 825 - protein, 78 aa, Artificial Sequence
  Synthetic Construct
ITCPPPMSVEHADIWVKSYSLYSRERYICNSGFKRKAGTSSLTECVLNKATNVAHWTTPSLKCIRDPALVHQRPAPPS

SEQ ID NO: 826 - protein, 213 aa, Artificial Sequence
  Synthetic Construct
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFERHLEFEARTLSPGHTWEEAPLLTLKQKQEWISLETLTPDTQYEFQVRVKPLQGEFTTWSPWSQPLAFRTKPAALGKD

SEQ ID NO: 827 - protein, 213 aa, Artificial Sequence
  Synthetic Construct
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFEDHLEFEARTLSPGHTWEEAPLLTLKWKQEWISLATLTPDTQYEFQVRVKPLQGEFTTWSPWSQPLAFRTKPAALGKD

SEQ ID NO: 828 - protein, 444 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFERHLEFEARTLSPGHTWEEAPLLTLKQKQEWISLETLTPDTQYEFQVRVKPLQGEFTTWSPWSQPLAFRTKPAALGKD

SEQ ID NO: 829 - protein, 444 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGPGSGSAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRSNISWEISQASHYFEDHLEFEARTLSPGHTWEEAPLLTLKWKQEWISLATLTPDTQYEFQVRVKPLQGEFTTWSPWSQPLAFRTKPAALGKD

SEQ ID NO: 830 - protein, 444 aa, Artificial Sequence; identical to SEQ ID NO: 828
  Synthetic Construct

What is claimed is:

1. A masked cytokine comprising:

a) a first half-life extension domain and a second half-life extension domain, wherein the first half-life extension domain is a first Fc domain or fragment thereof, and the second half-life extension domain is a second Fc domain or fragment thereof;

b) a masking moiety comprising an amino acid sequence having at least about 98% sequence identity to the amino acid sequence of SEQ ID NO: 10; and c) a cytokine, wherein the cytokine is an IL-2 polypeptide, wherein the IL-2 polypeptide comprises the amino acid sequence of SEQ ID NO: 3;

wherein the masking moiety is linked to the first half-life extension domain via a first linker, wherein the first linker comprises a cleavable peptide;

wherein the cytokine is linked to the second half-life extension domain via a second linker; and wherein the first half-life extension domain and the second half-life extension domain contain modifications promoting the association of the first and the second half-life extension domain.

2. The masked cytokine of claim 1, wherein the masking moiety comprises the amino acid sequence of SEQ ID NO: 826.

3. The masked cytokine of claim 1, wherein the first Fc domain or fragment thereof comprises the amino acid sequence of SEQ ID NO: 155, and the second Fc domain or fragment thereof comprises the amino acid sequence of SEQ ID NO: 156.

4. The masked cytokine of claim 1, wherein the cleavable peptide comprises an amino acid sequence of SEQ ID NO: 96.

5. The masked cytokine of claim 1, wherein the first linker comprises an amino acid sequence of SEQ ID NO: 15, and the second linker comprises an amino acid sequence of SEQ ID NO: 339.

6. A pharmaceutical composition comprising the masked cytokine of claim 1, and a pharmaceutically acceptable carrier.

7. A kit comprising the masked cytokine of claim 1.

8. The masked cytokine of claim 2, wherein the first Fc domain or fragment thereof comprises the amino acid sequence of SEQ ID NO: 155, and the second Fc domain or fragment thereof comprises the amino acid sequence of SEQ ID NO: 156.

9. The masked cytokine of claim 2, wherein the cleavable peptide comprises an amino acid sequence of SEQ ID NO: 96.

10. The masked cytokine of claim 2, wherein the first linker comprises an amino acid sequence of SEQ ID NO: 15, and the second linker comprises an amino acid sequence of SEQ ID NO: 339.

11. The masked cytokine of claim 1, wherein the masking moiety comprises an amino acid sequence of SEQ ID NO: 826; wherein the first Fc domain or fragment thereof comprises the amino acid sequence of SEQ ID NO: 155, and the second Fc domain or fragment thereof comprises the amino acid sequence of SEQ ID NO: 156; and wherein the first linker comprises an amino acid sequence of SEQ ID NO: 15, and the second linker comprises an amino acid sequence of SEQ ID NO: 339.

12. A pharmaceutical composition comprising the masked cytokine of claim 2, and a pharmaceutically acceptable carrier.

13. A kit comprising the masked cytokine of claim 2.

14. A pharmaceutical composition comprising the masked cytokine of claim 11, and a pharmaceutically acceptable carrier.

15. A kit comprising the masked cytokine of claim 11.

* * * * *